(12) United States Patent
Dupuy et al.

(10) Patent No.: US 10,533,161 B2
(45) Date of Patent: Jan. 14, 2020

(54) NADPH OXIDASE PROTEINS

(71) Applicants: Universite Grenoble Alpes, Saint Martin D'Heres (FR); Centre National de la Recherche Scientifique, Paris (FR)

(72) Inventors: Jérôme Dupuy, Saint Quentin Sur Isère (FR); Christine Hajjar, Bekaa (LB); Mickaël Cherrier, Tullins (FR); Franck Fieschi, Vif (FR)

(73) Assignees: UNIVERSITE GRENOBLE ALPES, Saint Martin D'Heres (FR); CENTRE NATIONAL DE LA RECHERCHE SCIENTIFIQUE, Paris (FR)

( * ) Notice: Subject to any disclaimer, the term of this patent is extended or adjusted under 35 U.S.C. 154(b) by 210 days.

(21) Appl. No.: 15/306,137

(22) PCT Filed: Apr. 22, 2015

(86) PCT No.: PCT/FR2015/051101
§ 371 (c)(1),
(2) Date: Oct. 24, 2016

(87) PCT Pub. No.: WO2015/162383
PCT Pub. Date: Oct. 29, 2015

(65) Prior Publication Data
US 2017/0088826 A1 Mar. 30, 2017

(30) Foreign Application Priority Data
Apr. 22, 2014 (FR) ...................... 1453616

(51) Int. Cl.
| C12N 9/00 | (2006.01) |
| C12Q 1/26 | (2006.01) |
| C12Q 1/28 | (2006.01) |
| G01N 33/52 | (2006.01) |
| C12N 9/02 | (2006.01) |

(52) U.S. Cl.
CPC .............. *C12N 9/0036* (2013.01); *C12Q 1/28* (2013.01); *C12Y 106/03001* (2013.01); *G01N 33/52* (2013.01); *G01N 2333/90209* (2013.01)

(58) Field of Classification Search
None
See application file for complete search history.

(56) References Cited

U.S. PATENT DOCUMENTS

2005/0020813 A1* 1/2005 Masignani ......... C07K 14/3156
530/350

FOREIGN PATENT DOCUMENTS

| WO | 0100668 | 1/2001 |
| WO | 02077183 | 10/2002 |
| WO | 2004011670 | 2/2004 |
| WO | 2005058942 | 6/2005 |
| WO | 2011062864 | 5/2011 |

OTHER PUBLICATIONS

Stover et al., "Complete genome sequence of Pseudomonas aeruginosa PAO1, an opportunistic pathogen", Nature, 2000, vol. 406, pp. 959-964.*
Nisimoto, Yukio et al: "Activation of the flavoprotein domain of gp91phox upon interaction with N-terminal p67phox (1-210) and the rac complex," 2004, Biochemistry, vol. 43:9567-9575.
Prosser, Benjamin L. et al: "X-Ros signaling: rapid mechano-chemo transduction in heart," Science, 2011, vol. 333:1440-1445.
Rotrosen, Daniel et al: "Production of recombinant cytochrome b558 allows reconstitution of the phagocyte NADPH oxidase solely from recombinant proteins," The Journal of Biological Chemistry, 1993, vol. 268, No. 19:14256-14260.
Taylor, Ross M. et al: "Analysis of human phagocyte flavocytochrome b558 by mass spectrometry," The Journal of Biological Chemistry, 2006, vol. 281, No. 48, pp. 37045-37056.
Zhang, Ji-hu, et al: "A simple statistical parameter for use in evaluation and validation of high throughput screening assays," Journal of Biomolecular Screening, 1999, vol. 4, No. 2:67-73.
Zhen, Ling et al: "Gene targeting of X chromosome-linked chronic granulomatous disease locus in a human myeloid leukemia cell line and rescue by expression of recombinant gp91phox," Proc. Natl. Acad. Sci., 1993, vol. 90:9832-9836.
XP-002733520; Williams, T. et al: "Oxidoreductase NAD-binding domain protein," Database UniProt, May 29, 2013.
XP-002733521; Hung, D. et al: "Uncharacterized Protein," Database UniProt, Jan. 22, 2014.
XP-002733522; Harvill, E.T., et al: "Ferric Reductase-Like Transmembrane Component," Database UniProt, Feb. 19, 2014.
Dahlgren, Claes and Anna Karlsson: "Respiratory burst in human neutrophils," Journal of Immunological Methods, 1999, vol. 232:3-14.
De Deken, Xavier et al: "Cloning of two human thyroid cDNAs encoding new members of the NADPH oxidase family," The Journal of Biological Chemistry, 2000, vol. 275, No. 30:23227-23233.
De Mendez, Isabelle and Thomas L. Leto: "Functional reconstitution of the phagocyte NADPH oxidase by transfection of its multiple components in a heterologous system," Blood, 1995, vol. 85, No. 4:1104-1110.
Green, Terrence R. And David E. Wu: "Detection of NADPH diaphorase activity associated with human neutrophil NADPH-O2 oxidoreductase activity," Federation of European Biochemical Societies, 1985, vol. 179, No. 1:82-86.
Han, Chang-Hoon et al: "Characterization of the flavoprotein domain of gp91phox which has NADPH diaphorase activity," J. Biochem., 2001, vol. 129: 513-520.

(Continued)

*Primary Examiner* — Suzanne M Noakes
(74) *Attorney, Agent, or Firm* — Cuenot, Forsythe & Kim, LLC; Stanley A. Kim

(57) ABSTRACT

A NADPH oxidase (Nox) protein includes a domain including 3 to 7 transmembrane helices, and an amino acid sequence including at least 2 bis-histidyl motifs, wherein each of the bis-histidyl motifs consists of 2 histidine residues separated by 12, 13 or 14 amino acid residues. The Nox protein may be produced by a method that includes solubilizing a solution of cells expressing the Nox protein using a detergent from the maltoside family to suspend the Nox protein in the solution.

11 Claims, 17 Drawing Sheets

Specification includes a Sequence Listing.

(56) References Cited

OTHER PUBLICATIONS

Lambeth, J. David: "NOX enzymes and the biology of reactive oxygen," Nature Reviews, Immunology, Mar. 2004, vol. 4:181-189.
Lord, Connie I. et al: "Single-step immunoaffinity purification and functional reconstitution of human phagocyte flavocytochrome b," Journal of Immunological Methods, 2008, vol. 329:201-107.
Mizrahi, Ariel et al: "A prenylated p47phox -p67phox -Rac1 chimera is a quintessential NADPH oxidase activator," The Journal of Biological Chemistry, 2010, vol. 285, No. 33:25485-25499.
Nisimoto, Yukio et al: "Activation of the flavoprotein domain of gp91phox upon interaction with N-terminal p67phox (1-210) and the rac complex," 2004, Biochemistry, vol. 43:9567-9575.
Ostuni, Mariano A. et al: "Expression of functional mammal flavocytochrome b558 in yeast: comparison with improved insect cell system," Biochimica et Biophysica Acta 1798, 2010, pp. 1179-1188.
Price, Marianne O. et al: "Creation of a genetic system for analysis of the phagocyte respiratory burst: high-level reconstitution of the NADPH oxidase in a nonhematopoietic system," Blood, 2002, vol. 99, No. 8:2653-2661.

\* cited by examiner

Human Nox protein (*Nox2*)

SEQ ID No: 370

Nox protein of *Streptococcus pneumoniae* (*Sp*Nox)

B

SEQ ID No: 24

Nox protein of Pseudomonas *aeruginosa* (*Pa*Nox)

SEQ ID No: 25

Nox protein of Escherichia coli (EcNox)

SEQ ID No: 26

NADPH OXIDASE PROTEINS

CROSS REFERENCE TO RELATED APPLICATIONS

The present application is the U.S. national phase under 35 U.S.C. 371 of international patent application number PCT/FR2015/051101 filed on Apr. 22, 2015, which designated the U.S.

FIELD OF THE INVENTION

The present invention relates to novel NADPH oxidase proteins, the use thereof, the method of preparation thereof and the method for identifying them.

SEQUENCE LISTING

The instant application contains a substitute Sequence Listing which has been submitted electronically in an ASCII text file named 7077-0002_SL.txt on Jun. 4, 2019. The substitute Sequence Listing is hereby incorporated by reference in its entirety.

BACKGROUND

The NADPH oxidase proteins, or Nox, are tissue-specific modular proteins of very wide occurrence in eukaryotes. They share a catalytic core consisting of an FNR (flavin-containing ferredoxin NADPH oxidoreductase-like) domain and an FRD (ferric reductase domain), bound to the membrane, fixing 2 haems (Nox 1 to 4). They may also have, as Nox5, a calmodulin domain and in addition, as in the case of Duox1 and Duox2, an additional transmembrane segment and a domain of the peroxidase type at the N-terminal end (Lambeth J D, NOX enzymes and the biology of reactive oxygen, Nature Reviews, 2004, Immunology, 4:181-189). Although the two domains FNR and cytochrome b are found in prokaryotes, pure and simple sequence alignments have never allowed Nox or Fre proteins to be detected in the bacterial genomes.

In terms of function, in addition to Nox2, which is found both in phagocytes, in which it is involved in immune defence, and in the cardiac tissues, in which it plays a role in muscle contraction, the Nox enzymes are involved in multiple processes such as cellular proliferation, apoptosis, or intra- and intercellular communication. Moreover, the Duox enzymes are involved in the synthesis of the thyroid hormones (Prosser B L et al., X-ROS signaling: rapid mechano-chemo transduction in heart, 2011, Science, 333: 1440-1445; De Deken X et al., Cloning of two human thyroid cDNAs encoding new members of the NADPH oxidase family, The Journal of Biological Chemistry, 275: 23227-23233). In yeast, the ferric reductases (Fre) for their part are involved in the reduction of ferric ions to ferrous ions during iron import.

In a controlled manner, the Nox proteins lead to the production of reactive oxygen species (ROS), such as the superoxide ions $O_2.^-$, hydrogen peroxide ($H_2O_2$), or the OH. hydroxyl radical. Recent accumulation of data indicates that the ROS have a much more subtle role than was initially attributed in the immune system. Their importance in molecular and cellular mechanisms such as signalling, chemical reactivity, or toxicity induced by the redox potential of the species produced, therefore places the Nox proteins henceforth in the rank of high-added-value therapeutic targets.

To identify new medicaments capable of specifically targeting this protein family, the pharmaceutical industry screens small molecules to determine their effects with respect to Nox proteins. These small molecules are then improved by organic synthesis in order to optimize their effects.

Now, taking into account the eukaryotic origin of the Nox proteins, their capacity as membrane proteins, their modes of regulation, and their specific post-translational modifications (Nox1-4, Nox5 and Duox1-2), current pharmaceutical research must tackle the difficulties inherent in the very nature of these Nox proteins. In other words, it is difficult to produce in sufficient quantities a highly regulated glycosylated membrane system, with multiple components.

For carrying out screening assays, it is however necessary on the one hand to obtain functional Nox proteins to evaluate the actual impact of the molecules tested, and on the other hand to produce sufficient quantities of Nox proteins so as to be able to test a large number of molecules. Now, the Nox proteins produced in large quantities are mainly inactive, whereas the functional Nox proteins themselves are obtained in insignificant quantities. This has the effect of making their production cost too high to envisage screening assays on a large scale.

Currently, human Nox proteins have already been produced in cells of the immune system (Taylor R M et al., Analysis of human phagocyte flavocytochrome b(558) by mass spectrometry, J Biol Chem 2006, Dec. 1, 281(48): 37045-56; Lord C I et al., Single-step immunoaffinity purification and functional reconstitution of human phagocyte flavocytochrome b, J Immunol Methods, 2008, Jan. 1, 329(1-2):201-7) and various attempts at heterologous expression have also been envisaged, but without success (de Mendez I, Leto T L, Functional reconstitution of the phagocyte NADPH oxidase by transfection of its multiple components in a heterologous system, Blood, 1995, Feb. 15, 85(4):1104-10; Price M O et al. Creation of a genetic system for analysis of the phagocyte respiratory burst: high-level reconstitution of the NADPH oxidase in a nonhematopoietic system. Blood, 2002, Apr. 15, 99(8):2653-61; Zhen L et al., Gene targeting of X chromosome-linked chronic granulomatous disease locus in a human myeloid leukemia cell line and rescue by expression of recombinant gp91phox. Proc Natl Acad Sci USA, 1993 Nov. 1, 90(21):9832-6).

Mammalian Nox proteins have in particular been expressed heterologously in various eukaryotic organisms, such as in insect cells (Rotrosen D et al., Production of recombinant cytochrome b558 allows reconstitution of the phagocyte NADPH oxidase solely from recombinant proteins, J Biol Chem, 1993, Jul. 5, 268(19):14256-60) or in yeast (Ostuni M A et al., Expression of functional mammal flavocytochrome b(558) in yeast: comparison with improved insect cell system. Biochim Biophys Acta, 2010 June, 1798 (6):1179-88).

However, none of these approaches has made it possible to produce functional Nox proteins in sufficient quantities to envisage high-throughput screening.

Moreover, heterologous expression systems have also been tested in attempts to produce eukaryotic Nox proteins in prokaryotic organisms, in particular in the bacterium *Escherichia coli*, but only truncated forms of the eukaryotic Nox proteins have been produced (Han C H et al., Characterization of the flavoprotein domain of gp91phox which has NADPH diaphorase activity, J Biochem, 2001 April 129(4): 513-20; Nisimoto Y et al. Activation of the flavoprotein domain of gp91 phox upon interaction with N-terminal p67phox (1-210) and the Rac complex, Biochemistry, 2004, Jul. 27, 43(29):9567-75).

SUMMARY

In this context, the aim of the present invention is to propose novel Nox proteins, identified and characterized for the first time in prokaryotes. Use of these novel Nox proteins thus offers the advantage of allowing production of functional proteins in large quantity and at less cost compared to the eukaryotic Nox proteins.

An aspect of the invention is therefore to propose novel Nox proteins.

Another aspect of the invention is to propose a method for preparing these novel Nox proteins.

Another aspect of the invention is to propose a method for identifying these novel Nox proteins starting from bacterial protein sequences.

Another aspect of the invention finally relates to the applications of these novel Nox proteins.

In a first alternative, the invention relates to a Nox (or NADPH oxidase) protein having:
  a domain comprising from 3 to 7 transmembrane helices, and having an amino acid sequence comprising:
  at least 2 bis-histidyl motifs, each of the bis-histidyl motifs constituted by 2 histidine residues separated by 12, 13 or 14 amino acid residues, said 2 bis-histidyl motifs being located in the membrane part and separated by a transmembrane helix, and
  at least one first motif constituted by the sequence:

[G/S/A]-[Q/D]-F-[A/V/T/L/F]-[F/Y/W/LR]-[L/V/I/F/W]           (SEQ ID NO: 1), and
  at least one second motif constituted by the sequence:

[P/A/S/E/F]-H-[P/S/A]-F-[T/S]-[L/I/M/V]           (SEQ ID NO: 2), and
  at least one third motif constituted by the sequence:

[K/R]-X-X-G-[D/G]-X-[T/S]           (SEQ ID NO: 3),

X representing any natural amino acid, and
  at least one fourth motif constituted by the sequence:

(SEQ ID NO: 4)
G-[I/S/V/L]-G-[V/I/A/F]-[T/A/S]-[P/Y/T/A].

In the invention, the term "Nox", or "NADPH oxidase protein" refers to an enzyme catalysing the reaction of electron transfer from an electron donor, a homologue of NADPH, to a final acceptor, which is molecular oxygen. This results in the production of reactive oxygen species.

This NADPH oxidase activity of the Nox proteins occurs naturally in vivo in the organisms that produce them, but it can also be determined and measured in vitro using specific assays, via reduction reactions showing the production of superoxide ion (by colorimetry tracking the reduction of cytochrome c, or the reduction of NBT (Nitro Blue Tetrazolium), or also by fluorescence using amplex Red, and by chemiluminescence using luminol).

The term "membrane part" refers to the amino acids that are arranged in the lipid bilayer of the cell, when the Nox protein is expressed functionally. This membrane part contains the 2 haems of the Nox protein and consists essentially of amino acids folded in the form of a helices.

The present invention is based on the Inventors' surprising finding that proteins of the Nox family are present in prokaryotes.

For the first time, the Inventors have identified motifs present on the amino acid sequence of these Nox proteins, and these motifs make it possible to identify and correctly ascribe said Nox proteins.

The Inventors' approach is based on the identification of (i) a consensus motif corresponding to the FAD-binding domain, (ii) a consensus motif corresponding to the NADPH-binding domain and (iii) a domain comprising from 3 to 7 transmembrane helices (identified from the amino acid sequence) containing 2 bis-histidyl motifs of 12 to 14 amino acids separated by at least 20 amino acids (i.e. the length of a transmembrane helix), which are found in association in Nox proteins.

Moreover, the Inventors also identified, surprisingly, additional motifs present in most of the prokaryotic Nox, allowing them to be distinguished from the eukaryotic Nox.

The Nox proteins according to the invention may thus be identified from their amino acid sequence with the aid of the following 4 motifs:

1st motif:
(SEQ ID NO: 1)
[G/S/A]-[Q/D]-F-[A/V/T/L/F]-[F/Y/W/L/R]-

[L/V/I/F/W],

2nd motif:
(SEQ ID NO: 2)
[P/A/S/E/F]-H-[P/S/A]-F-[T/S]-[L/I/M/V], this motif corresponds to the FAD-binding site on the Nox protein, 3rd motif:

[K/R]-X-X-G-[D/G]-X-[T/S]           (SEQ ID NO: 3),

4th motif:

G-[I/S/V/L]-G-[V/I/A/F]-[T/A/S]-[P/Y/T/A]           (SEQ ID NO: 4), this motif corresponds to the NADPH-binding site on the Nox protein.

The amino acids shown in square brackets correspond to alternative amino acids for the position considered on the consensus sequence.

In a second alternative, another aspect of the invention relates to a Nox protein having:
  a domain comprising from 3 to 7 transmembrane helices, and having an amino acid sequence comprising:
  at least 2 bis-histidyl motifs, each of the bis-histidyl motifs being constituted by 2 histidine residues separated by 12, 13 or 14 amino acid residues, said 2 bis-histidyl motifs being located in the membrane part and separated by a transmembrane helix, and
  at least one motif A constituted by the sequence:

G-[Q/D]-F-A-[F/Y]-[L/V]           (SEQ ID NO: 5), and
  at least one motif B constituted by the sequence:

H-[P/S/A]-F-[T/S]-[L/I/M/V]           (SEQ ID NO: 6), and
  at least one motif C constituted by the sequence:

(SEQ ID NO: 4)
G-[I/S/V/L]-G-[V/I/A/F]-[T/A/S]-[P/Y/T/A].

According to this aspect of the invention, the Nox proteins may be identified with the aid of the following 3 motifs:

motif A: G-[Q/D]-F-A-[F/Y]-[L/V], (SEQ ID NO: 5)

motif B:

H-[P/S/A]-F-[T/S]-[L/I/M/V] (SEQ ID NO: 6), this motif corresponds to the FAD-binding site on the Nox protein
motif C:

G-[I/S/V/L]-G-[V/I/A/F]-[T/A/S]-[P/Y/T/A] (SEQ ID NO: 4), this motif corresponds to the NADPH-binding site on the Nox protein.

In a third alternative, another aspect of the invention relates to a Nox protein having:
- a domain comprising from 3 to 7 transmembrane helices, and having an amino acid sequence comprising:
  - at least 2 bis-histidyl motifs, each of the bis-histidyl motifs being constituted by 2 histidine residues separated by 12, 13 or 14 amino acid residues, said 2 bis-histidyl motifs being located in the membrane part and separated by a transmembrane helix, and
  - at least one motif A' constituted by the sequence:

G-[Q/D]-F-[A/V/T/L/F]-[F/Y/W/L/R]-[L/V/I/F/W]-
   [K/T/R/S/A/E/N] (SEQ ID NO: 7), and
at least one motif B' constituted by the sequence:

[P/A/S/E/F]-H-[P/S/A]-F-[T/S]-[L/I/M/Y] (SEQ ID NO: 2), and
at least one motif C' constituted by the sequence:

G-[I/S/V/L]-G-[V/I/A/F]-[T/A/S]-[P/Y/T/A]. (SEQ ID NO: 4)

According to this aspect of the invention, the Nox proteins may be identified with the aid of the following 3 motifs:

motif A':
G-[Q/D]-F-[A/V/T/L/F]-[F/Y/W/L/R]-[L/V/I/F/W]- (SEQ ID NO: 7)
[K/T/R/S/A/E/N], motif B':

[P/A/S/E/F]-H-[P/S/A]-F-[T/S]-[L/I/M/V] (SEQ ID NO: 2), this motif corresponds to the FAD-binding site on the Nox protein,
motif C':

G-[I/S/V/L]-G-[V/I/A/F]-[T/A/S]-[P/Y/T/A] (SEQ ID NO: 4), this motif corresponds to the NADPH-binding site on the Nox protein.

The three alternatives of the invention correspond to Nox proteins identified in prokaryotic organisms. However, it is not excluded that Nox proteins according to the invention might be identified in eukaryotic organisms.

In an embodiment of the first alternative, the invention relates to a Nox protein as defined above, in which said first motif is selected from the group constituted by the sequences SEQ ID NO: 8, SEQ ID NO: 9 and SEQ ID NO: 10.

The sequences SEQ ID NO: 8 to 10 correspond respectively to the motifs present on the Nox proteins of *Streptococcus pneumoniae, Pseudomonas aeruginosa* and *Escherichia coli* (SEQ ID NO: 8), *Salmonella enterica* and *Bordetella pertussis* (SEQ ID NO: 9) and *Vibrio cholerae* (SEQ ID NO: 10).

In an embodiment of the first alternative, the invention relates to a Nox protein as defined above, in which said second motif is selected from the group constituted by the sequences SEQ ID NO: 11, SEQ ID NO: 12, SEQ ID NO: 13 and SEQ ID NO: 14.

The sequences SEQ ID NO: 11 to 14 correspond respectively to the motifs present on the Nox proteins of *Streptococcus pneumoniae* (SEQ ID NO: 11), *Pseudomonas aeruginosa, Salmonella enterica* and *Bordetella pertussis* (SEQ ID NO: 12), *Vibrio cholerae* (SEQ ID NO: 13) and *Escherichia coli* (SEQ ID NO: 14).

In an embodiment of the first alternative, the invention relates to a Nox protein as defined above, in which said third motif is selected from the group constituted by the sequences SEQ ID NO: 15, SEQ ID NO: 16, SEQ ID NO: 17, SEQ ID NO: 18, SEQ ID NO: 19 and SEQ ID NO: 20.

The sequences SEQ ID NO: 15 to 20 correspond respectively to the motifs present on the Nox proteins of *Streptococcus pneumoniae* (SEQ ID NO: 15), *Pseudomonas aeruginosa* (SEQ ID NO: 16), *Escherichia coli* (SEQ ID NO: 17), *Vibrio cholerae* (SEQ ID NO: 18), *Salmonella enterica* (SEQ ID NO: 19) and *Bordetella pertussis* (SEQ ID NO: 20).

In an embodiment of the first alternative, the invention relates to a Nox protein as defined above, in which said fourth motif is selected from the group constituted by the sequences SEQ ID NO: 21, SEQ ID NO: 22 and SEQ ID NO: 23.

The sequences SEQ ID NO: 21 to 23 correspond respectively to the motifs present on the Nox proteins of *Streptococcus pneumoniae, Salmonella enterica, Escherichia coli* and *Bordetella pertussis* (SEQ ID NO: 21), *Pseudomonas aeruginosa* (SEQ ID NO: 22) and *Vibrio cholerae* (SEQ ID NO: 23).

In a particular embodiment, the invention relates to a Nox protein as defined above, the amino acid sequence of which comprises, or consists of, a sequence having at least 90% identity, preferably 91%, 92%, 93%, 94%, 95%, 96%, 97%, 98%, 99% or 100% identity with SEQ ID NO: 24.

The sequence SEQ ID NO: 24 corresponds to a Nox protein identified in *Streptococcus pneumoniae*.

The "percentage identity" between two amino acid sequences, within the meaning of the present invention, is determined by comparing the two optimally aligned sequences through a comparison window. The part of the amino acid sequence in the comparison window may thus comprise additions or deletions (for example "gaps") relative to the reference sequence (which would not comprise these additions or deletions) so as to obtain optimum alignment between the two sequences.

The percentage identity is calculated by determining the number of positions for which an amino acid residue is identical in the two sequences being compared, then dividing the number of positions for which there is identity between the two amino acid residues, by the total number of positions in the comparison window, and then multiplying the result by one hundred to obtain the percentage amino acid identity between the two sequences.

In a particular embodiment, the invention relates to a Nox protein as defined above, the amino acid sequence of which comprises, or consists of, a sequence having at least 90% identity, preferably 91%, 92%, 93%, 94%, 95%, 96%, 97%, 98%, 99% or 100% identity with SEQ ID NO: 25.

The sequence SEQ ID NO: 25 corresponds to a Nox protein identified in *Pseudomonas aeruginosa*.

In a particular embodiment, the invention relates to a Nox protein as defined above, the amino acid sequence of which comprises, or consists of, a sequence having at least 90% identity, preferably 91%, 92%, 93%, 94%, 95%, 96%, 97%, 98%, 99% or 100% identity with SEQ ID NO: 26.

The sequence SEQ ID NO: 26 corresponds to a Nox protein identified in *Escherichia coli*.

In a particular embodiment, the invention relates to a Nox protein as defined above, the amino acid sequence of which comprises, or consists of, a sequence having at least 90% identity, preferably 91%, 92%, 93%, 94%, 95%, 96%, 97%, 98%, 99% or 100% identity with SEQ ID NO: 27.

The sequence SEQ ID NO: 27 corresponds to a Nox protein identified in *Vibrio cholerae*.

In a particular embodiment, the invention relates to a Nox protein as defined above, the amino acid sequence of which comprises, or consists of, a sequence having at least 90% identity, preferably 91%, 92%, 93%, 94%, 95%, 96%, 97%, 98%, 99% or 100% identity with SEQ ID NO: 28.

The sequence SEQ ID NO: 28 corresponds to a Nox protein identified in *Salmonella enterica*.

In a particular embodiment, the invention relates to a Nox protein as defined above, the amino acid sequence of which comprises, or consists of, a sequence having at least 90% identity, preferably 91%, 92%, 93%, 94%, 95%, 96%, 97%, 98%, 99% or 100% identity with SEQ ID NO: 29.

The sequence SEQ ID NO: 29 corresponds to a Nox protein identified in *Bordetella pertussis*.

In an embodiment, the invention relates to a Nox protein as defined above, the amino acid sequence of which comprises, or consists of, a sequence selected from the group constituted by the sequences SEQ ID NO: 24 to 351.

The sequences SEQ ID NO: 24 to 351 correspond to 328 sequences of Nox proteins identified among the sequences accessible in the databases at 22 Jan. 2014.

In an embodiment, the invention relates to a Nox protein as defined above the amino acid sequence of which comprises, or consists of, a sequence selected from the group constituted by the sequences SEQ ID NO: 24, SEQ ID NO: 25, SEQ ID NO: 26, SEQ ID NO: 27, SEQ ID NO: 28 and SEQ ID NO: 29.

In a particular embodiment, the invention relates to a Nox protein as defined above, said Nox protein being a protein of a prokaryotic organism, said prokaryotic organism preferably being selected from the group constituted by *Streptococcus pneumoniae, Pseudomonas aeruginosa, Escherichia coli, Vibrio cholerae, Salmonella enterica* and *Bordetella pertussis*.

In another particular embodiment, the invention relates to a Nox protein as defined above, said Nox protein being an isolated protein.

In another particular embodiment, the invention relates to a Nox protein as defined above, said Nox protein being a recombinant protein.

In the invention, the term "recombinant protein" refers to a protein produced in a cell in which the gene coding for this protein has been inserted, for example using a plasmid vector. A recombinant protein can be produced heterologously in a cell of an organism different from that in which it was identified originally.

In another particular embodiment, the invention relates to a Nox protein as defined above, said Nox protein having a spectral signature in spectrophotometry from 250 to 700 nm that is similar, preferably identical, to one of the spectral signatures from 250 to 700 nm presented in FIG. 5.

The presence of the haems in the Nox protein can in fact be visualized by carrying out a measurement by the spectrophotometry technique. The presence of the haems induces a characteristic spectral signature from 250 to 700 nm, with a peak at 410 nm when the protein is in its oxidized state. Another characteristic spectrum of the Nox is the difference spectrum (reduced spectrum minus oxidized spectrum) having a major peak at 425 nm and another peak at 558 nm. Thus, analysis of the spectral signature makes it possible to visualize the presence of the haems and consequently verify the good folding and stability of the Nox protein analysed.

In another particular embodiment, the invention relates to a Nox protein as defined above, said Nox protein having NADPH oxidase activity leading to production of ROS in the presence of an electron donor, said NADPH oxidase activity capable of being detected in a sample comprising said Nox protein via a reaction showing production of superoxide ion, preferably by reduction of cytochrome c or by reduction of NBT (Nitro Blue Tetrazolium), and preferably by measuring absorbance by spectrophotometry, by chemiluminescence or by a colorimetric assay, carried out on the sample.

In another aspect, the invention also relates to a nucleic acid coding for a Nox protein defined above.

In an embodiment, the invention relates to a nucleic acid as defined above comprising, or consisting of, a sequence selected from the group constituted by the sequences SEQ ID NO: 352, SEQ ID NO: 353, SEQ ID NO: 354, SEQ ID NO: 355, SEQ ID NO: 356, SEQ ID NO: 357, SEQ ID NO: 358, SEQ ID NO: 359, SEQ ID NO: 360, SEQ ID NO: 361, SEQ ID NO: 362 and SEQ ID NO: 363.

The sequences SEQ ID NO: 352 to 357 correspond to nucleic acids coding for Nox proteins identified in *S. pneumoniae* (SEQ ID NO: 352), *P. aeruginosa* (SEQ ID NO: 353), *E. coli* (SEQ ID NO: 354), *V. cholerae* (SEQ ID NO: 355), *S. enterica* (SEQ ID NO: 356) and *B. pertussis* (SEQ ID NO: 357).

The sequences SEQ ID NO: 358 to 363 correspond to nucleic acids, the codons of which have been optimized to allow expression of Nox proteins of *S. pneumoniae* (SEQ ID NO: 358), *P. aeruginosa* (SEQ ID NO: 359), *E. coli* (SEQ ID NO: 360), *V. cholerae* (SEQ ID NO: 361), *S. enterica* (SEQ ID NO: 362) and *B. pertussis* (SEQ ID NO: 363), having a polyhistidine tail and a thrombin cleavage site.

In another aspect, the invention relates to an expression vector comprising a nucleic acid as defined above.

In an embodiment, the invention relates to an expression vector as defined above comprising, or consisting of, a sequence selected from the group constituted by the sequences SEQ ID NO: 364, SEQ ID NO: 365, SEQ ID NO: 366, SEQ ID NO: 367, SEQ ID NO: 368 and SEQ ID NO: 369.

In another aspect, the invention relates to a cell containing at least one expression vector as defined above.

In another embodiment, the invention relates to a cell as defined above, said cell being a bacterium, preferably selected from the group constituted by *Escherichia coli, Streptococcus pneumoniae, Pseudomonas aeruginosa, Vibrio cholerae, Salmonella enterica* and *Bordetella pertussis*.

Another aspect of the invention also relates to a method for preparing a Nox protein as defined above, starting from a cellular extract from cells producing said protein, contained in a suitable solution, comprising a step of solubilization of the cell membranes of said cellular extract in order to put said protein in suspension in said suitable solution.

Taking into account their complex structure and their membrane nature, the Nox proteins are difficult to produce and purify as it is difficult to dissolve the membrane to release the Nox protein without destabilizing its structure. Use of an unsuitable detergent leads, moreover, to degradation of the Nox protein.

However, the Inventors found, surprisingly, that the use of detergents of the maltoside type makes it possible to dissolve the Nox protein.

In an embodiment, the invention relates to a method as defined above, in which the step of solubilization of said cell membrane is carried out using at least one detergent from the maltoside family, preferably selected from the group of dodecyl-maltosides.

The detergent will thus coat the membrane part, replacing the membrane lipids. The detergent will then maintain the three-dimensional structure of the Nox protein, which will keep the haems in the membrane part during purification.

In an embodiment, the invention relates to a method as defined above, in which said at least one detergent is selected from the group constituted by:

1. 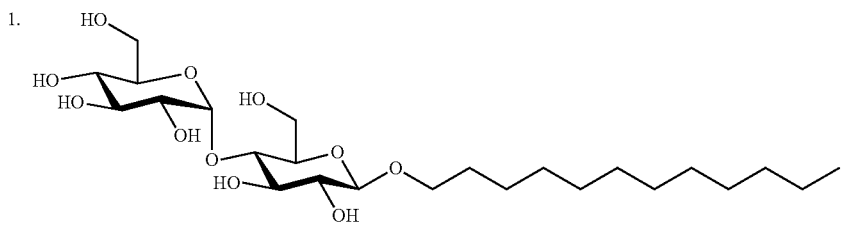

n-Dodecyl-β-D-Maltopyranoside,
n-Dodecyl-β-D-Maltoside
Lauryl Maltoside
Dodecyl 4-O-α-D-Glucopyranosyl-β-D-Glucopyranoside DDM/LM 2. 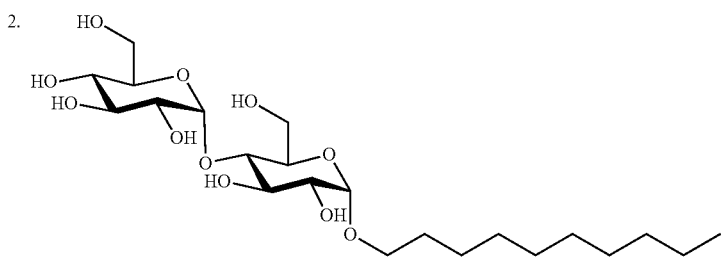

n-Decyl-α-D-Maltopyranoside
n-Decyl-α-D-Maltoside (High alpha)
Decyl Maltoside DM 3. 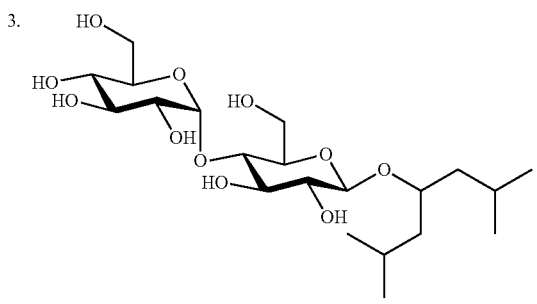

2,6-Dimethyl-4-Heptyl-β-D-Maltopyranoside

-continued
4.
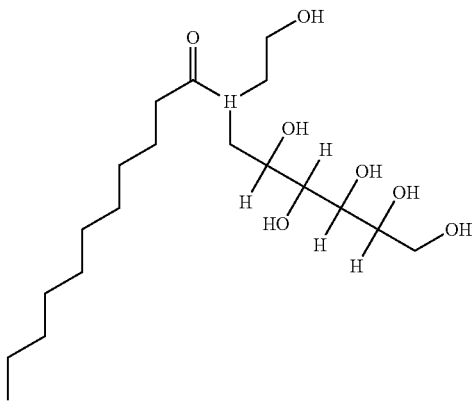
HEGA-11
Undecanoyl-N-Hydroxyethylglucamide
5.
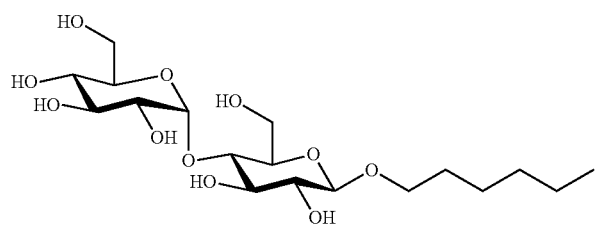
n-Hexyl-β-D-Maltopyranoside
n-Hexyl-β-D-Maltoside
6.
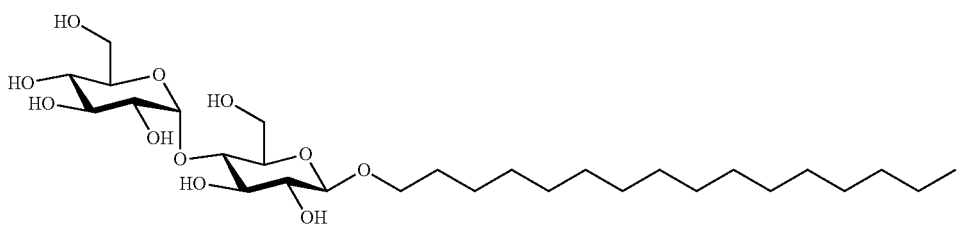
n-Hexadecyl-β-D-Maltopyranoside
n-Hexadecyl-β-D-Maltoside
7.
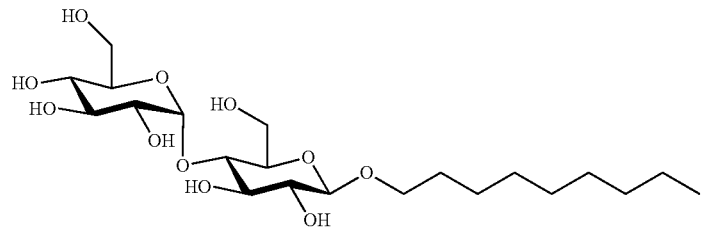
n-Nonyl-β-D-Maltopyranoside
n-Nonyl-β-D-Maltoside
8.
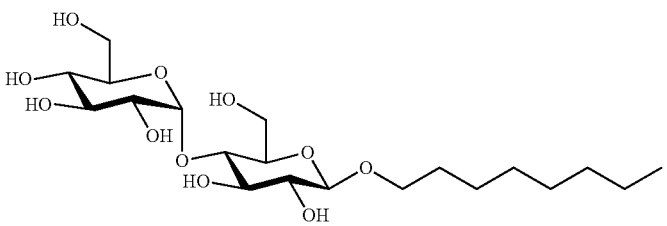
n-Octyl-β-D-Maltopyranoside
n-Octyl-β-D-Maltoside OM -continued
9.
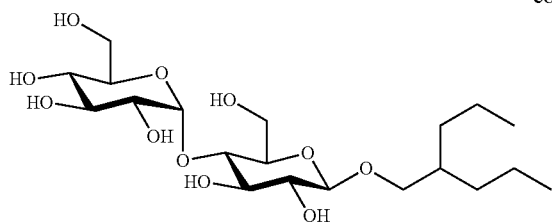
2-Propyl-1-Pentyl-β-D-Maltopyranoside
10.
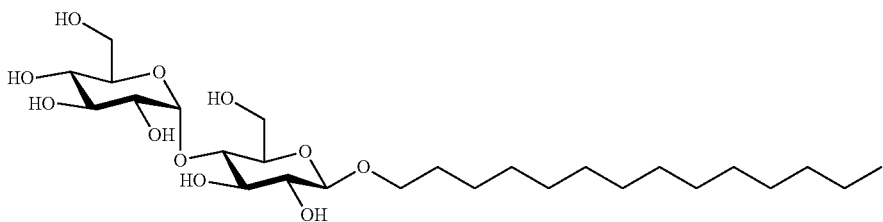
n-Tetradecyl-β-D-Maltopyranoside
n-Tetradecyl-β-D-Maltoside
Tetradecyl 4-O-α-D-Glucopyranosyl-β–D-Glucopyranoside
11.
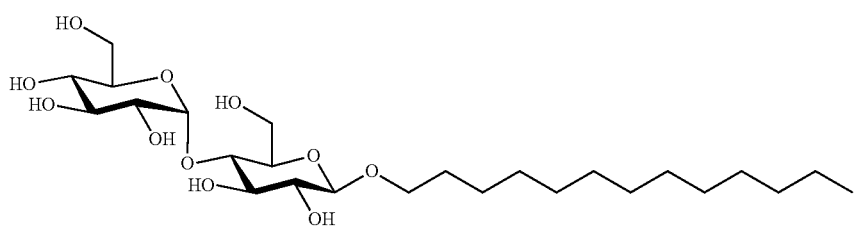
n-Tridecyl-β-D-Maltopyranoside
n-Tridecyl-β-D-Maltoside
12.
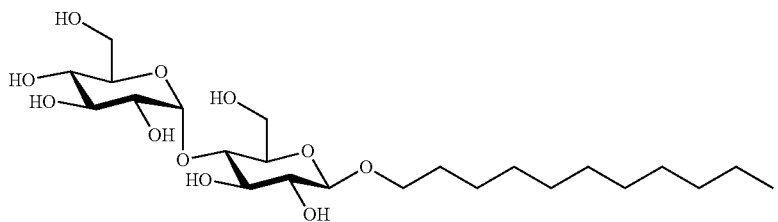
n-Undecyl-β-D-Maltopyranoside
n-Undecyl-β-D-Maltoside UM
13.
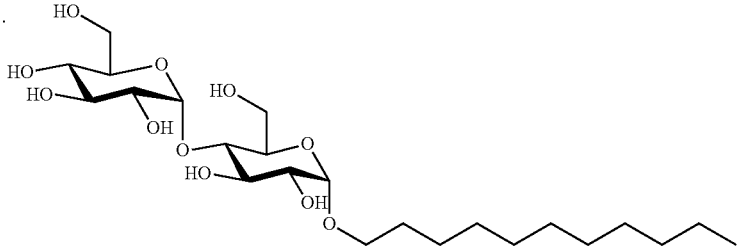
n-Undecyl-α-D-Maltopyranoside
n-Undecyl-α-D-Maltoside UM -continued 14.
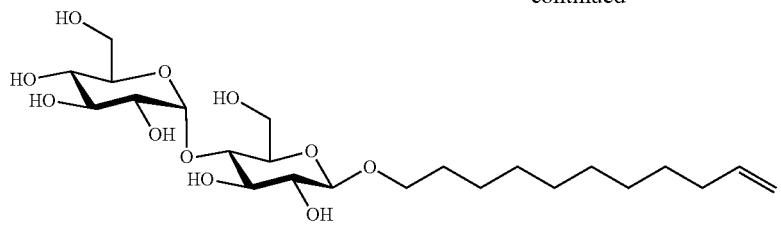
ω-Undecylenyl-β-D-Maltopyranoside
ω-Undecylenyl-β-D-Maltoside 15.
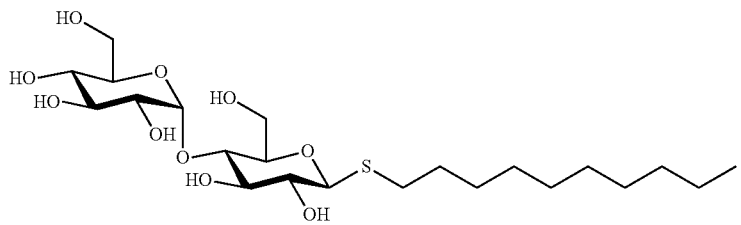
n-Decyl-β-D-Thiomaltopyranoside
n-Decyl-β-D-Thiomaltoside
DTM Decyl Thiomaltoside 16.
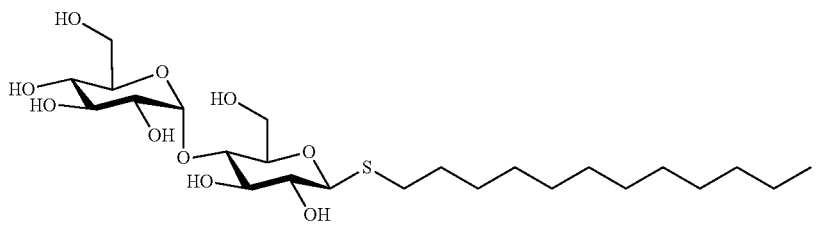
n-Dodecyl-β-D-Thiomaltopyranoside
n-Dodecyl-β-D-Thiomaltoside
LTM Lauryl Thiomaltoside 17.
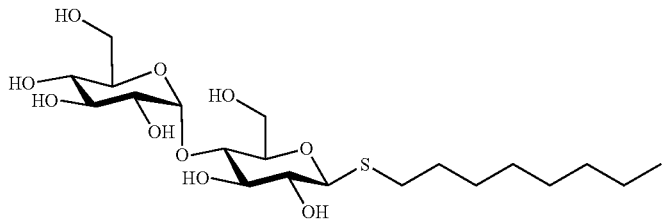
n-Octyl-β-D-Thiomaltopyranoside
n-Octyl-β-D-Thiomaltoside
NTM 18.
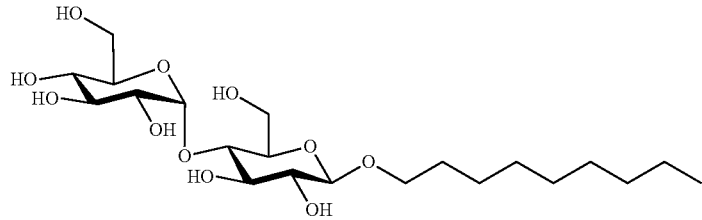
n-Nonyl-β-D-Thiomaltopyranoside
n-Nonyl-β-D-Thiomaltoside
NTM 19. 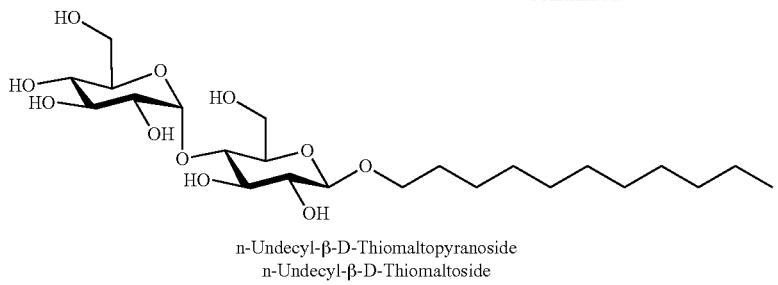
n-Undecyl-β-D-Thiomaltopyranoside
n-Undecyl-β-D-Thiomaltoside
20. 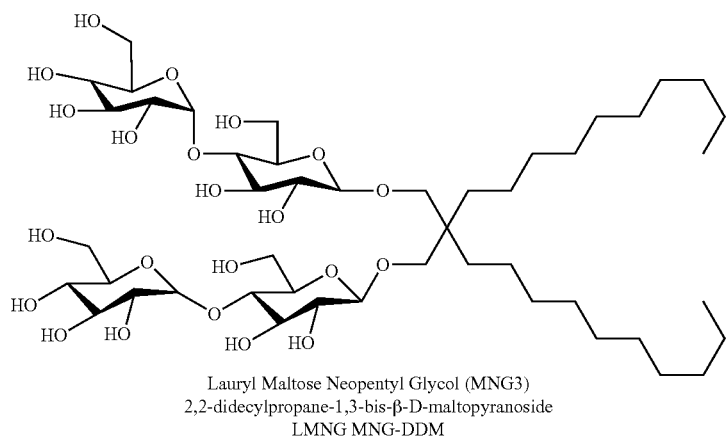
Lauryl Maltose Neopentyl Glycol (MNG3)
2,2-didecylpropane-1,3-bis-β-D-maltopyranoside
LMNG MNG-DDM
21. 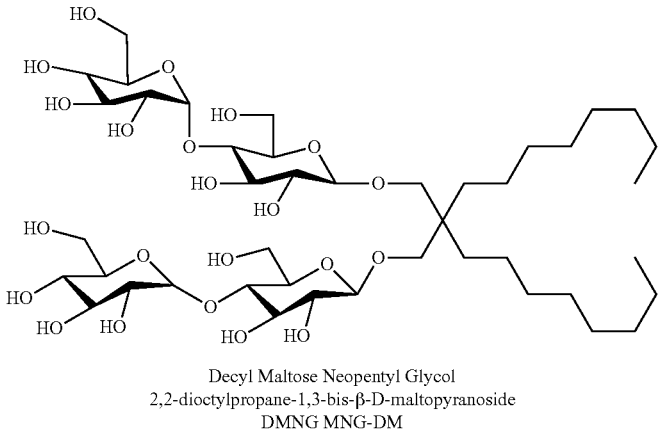
Decyl Maltose Neopentyl Glycol
2,2-dioctylpropane-1,3-bis-β-D-maltopyranoside
DMNG MNG-DM
22. 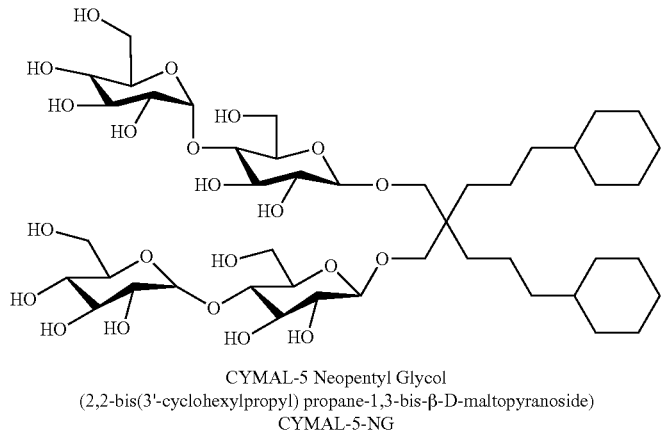
CYMAL-5 Neopentyl Glycol
(2,2-bis(3'-cyclohexylpropyl) propane-1,3-bis-β-D-maltopyranoside)
CYMAL-5-NG -continued
23.
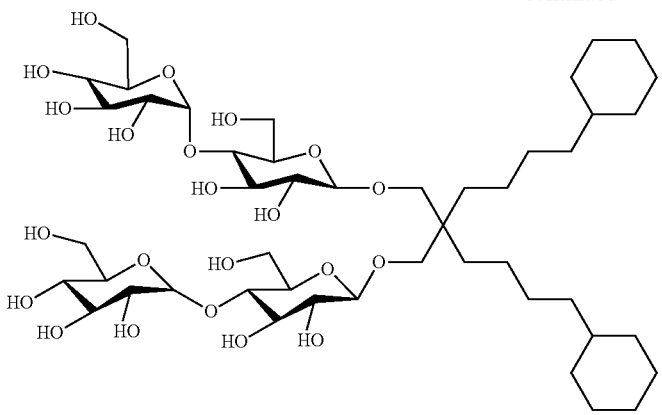
CYMAL-6 Neopentyl Glycol
(2,2-bis(3'-cyclohexylbutyl) propane-1,3-bis-β-D-maltopyranoside)
CYMAL-6-NG
24.
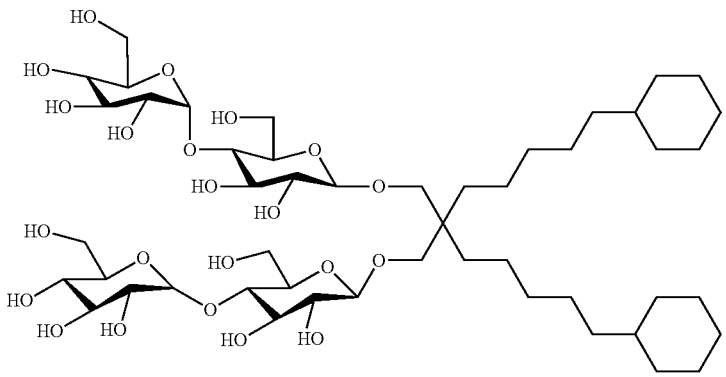
CYMAL-7 Neopentyl Glycol
(2,2-bis(3'-cyclohexylpentyl) propane-1,3-bis-β-D-maltopyranoside)
CYMAL-7-NG
25.
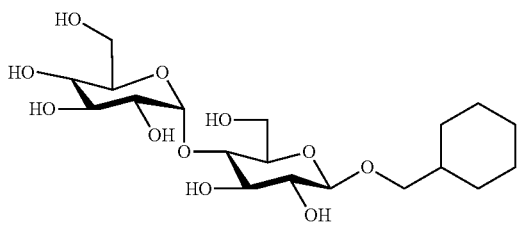
CYMAL-1
Cyclohexyl-Methyl-β-D-Maltoside 1
26.
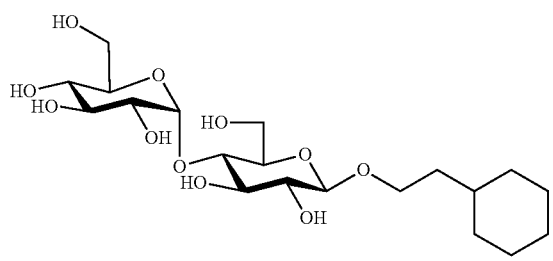
CYMAL-2
2-Cyclohexyl-1-Ethyl-β-D-Maltoside 1

-continued
27. 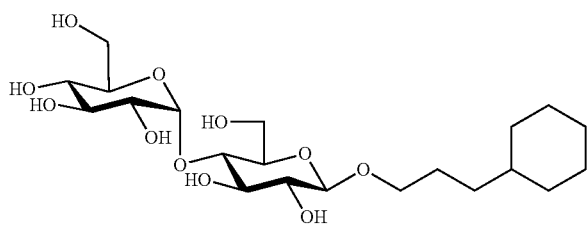
CYMAL-3
3-Cyclohexyl-1-propyl-β-D-Maltoside
28./ CYMAL-4
4-Cyclohexyl-1-Butyl-β-D-Maltoside
29. 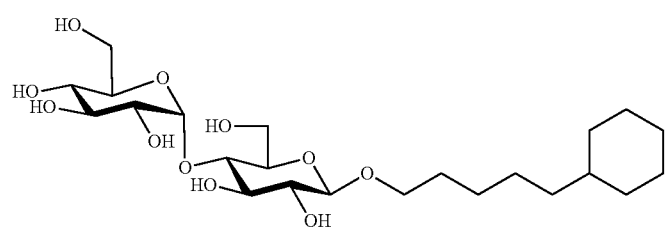
CYMAL-5
5-Cyclohexyl-1-Pentyl-β-D-Maltoside
30. 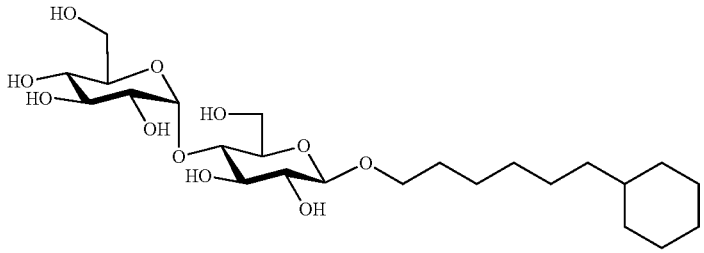
CYMAL-6
6-Cyclohexyl-1-Hexyl-β-D-Maltoside
31. 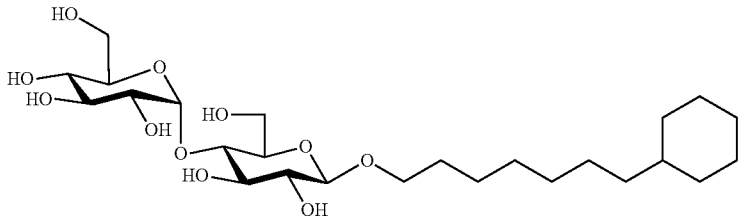
CYMAL-7
7-Cyclohexyl-1-Heptyl-β-D-Maltoside
32. 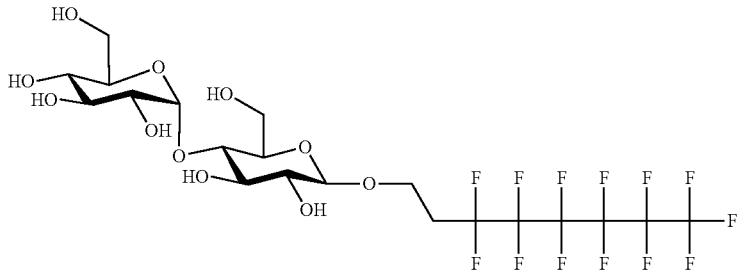
Octyl Maltoside, Fluorinated
(1H, 1H, 2H, 2H-Perfluorooctyl)-β-D-
Maltopyranoside FOM -continued
33.
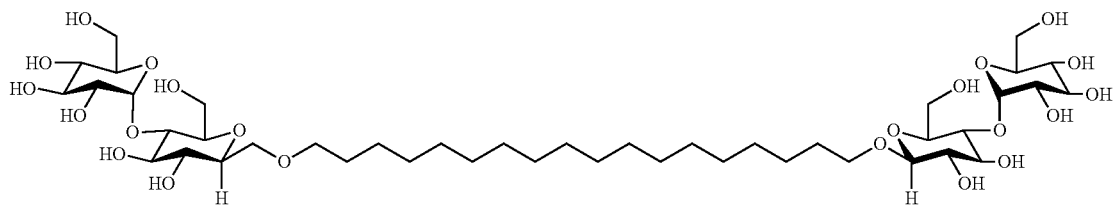
BisMalt-18
1,18-bis(β-D-Maltopyranosyl)
Octadecane
34.
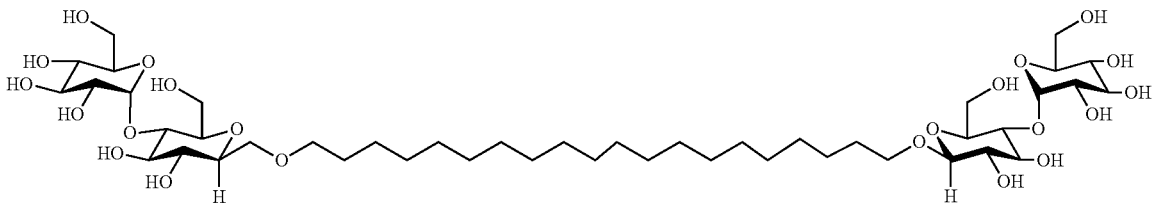
BisMalt-20
1,20-bis(β-D-maltopyranosyl)-
Docosane
35.
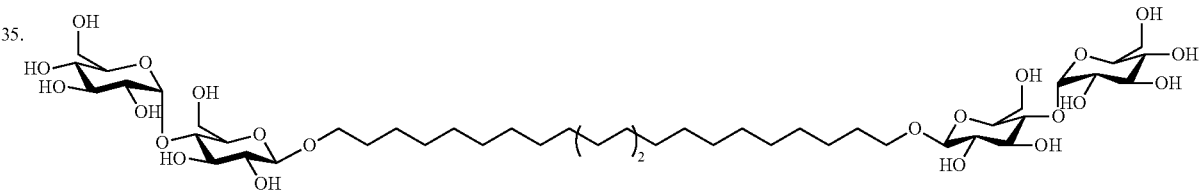
BisMalt-22
1,22-bis(β-D-maltopyranosyl)-
Docosane
36.
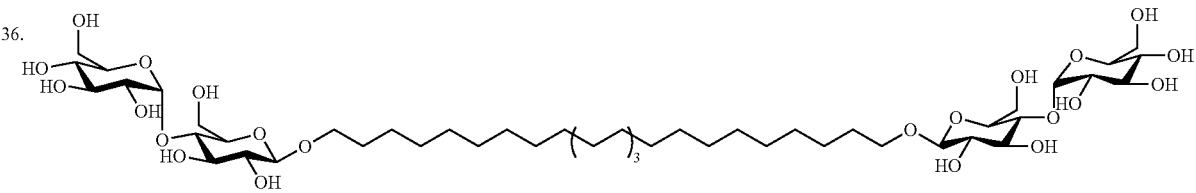
BisMalt-24
1,24-bis(β-D-Maltopyranosyl)-
Tetracosane
37.
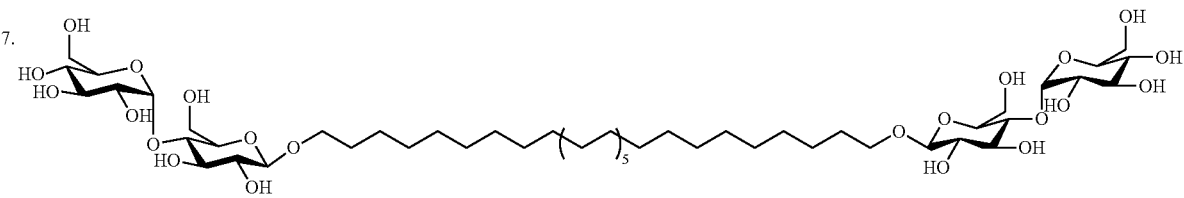
BisMalt-28
1,28-bis(β-D-Maltopyranosyl)-
Octacosane -continued

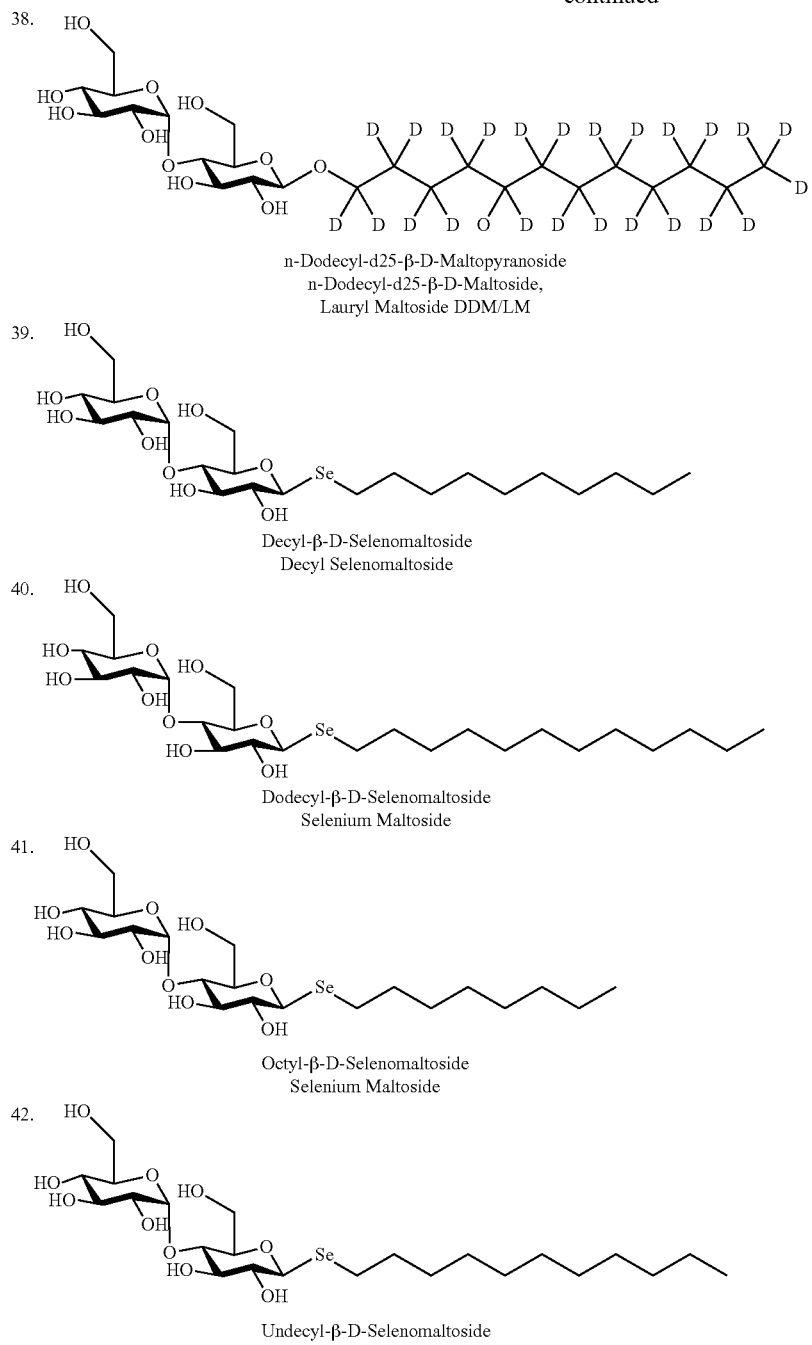

38. n-Dodecyl-d25-β-D-Maltopyranoside
n-Dodecyl-d25-β-D-Maltoside,
Lauryl Maltoside DDM/LM 39. Decyl-β-D-Selenomaltoside
Decyl Selenomaltoside 40. Dodecyl-β-D-Selenomaltoside
Selenium Maltoside 41. Octyl-β-D-Selenomaltoside
Selenium Maltoside 42. Undecyl-β-D-Selenomaltoside In an embodiment, the invention relates to a method as defined above, in which said at least one detergent is Lauryl Maltose Neopentyl Glycol (MNG3).

In a particular embodiment, the invention relates to a method as defined above, in which said at least one detergent is a mixture of detergents, in particular of maltosides, preferably a CYMAL-7/DDM or DDM/MNG3 mixture.

In a particular embodiment, the invention relates to a method as defined above, in which the step of solubilization of said cell membrane is carried out using a solution comprising 50 mM of Tris HCl at pH 7, 300 mM of NaCl and 5 mM of MNG3.

In an embodiment, the invention relates to a method as defined above, comprising, at the end of the solubilization step, a step of purification of said Nox protein in suspension in the suitable solution.

In an embodiment, the invention relates to a method as defined above, in which said at least one detergent is used at a concentration from 0.01 mM to 0.2 mM, preferably at 0.03 mM during said purification step.

In an embodiment, the invention relates to a method as defined above, in which the step of purification of said Nox protein is carried out by chromatography, preferably using a resin having a strong affinity for an amino acid motif present on said protein, said amino acid motif preferably being a polyhistidine tail.

In a particular embodiment, the invention relates to a method as defined above, in which said resin is sepharose.

Preferably, said resin is equilibrated with the same solution as that used for solubilization of the membrane, preferably with a solution comprising 50 mM of Tris HCl at pH 7, 300 mM of NaCl and 5 mM of MNG3.

In an embodiment, the invention relates to a method as defined above, in which said cells are bacteria, preferably selected from the group consisting of *Streptococcus pneumoniae, Pseudomonas aeruginosa, Escherichia coli, Vibrio cholerae, Salmonella enterica* and *Bordetella pertussis*.

In an embodiment, the invention relates to a method as defined above, comprising the steps of:
production of said Nox protein in bacteria,
lysis of the bacteria to obtain a cellular extract in a suitable solution,
bringing the cellular extract into contact with a detergent to dissolve the cell membranes and obtain said Nox protein in suspension in the suitable solution,
purification of said Nox protein in suspension in the suitable solution.

In an embodiment, the invention relates to a method as defined above, comprising the steps of:
production of said Nox protein in *E. coli* bacteria,
mechanical lysis of the bacteria by a microfluidizer to obtain a cellular extract in a suitable solution,
bringing the cellular extract into contact with a solution comprising 50 mM of Tris HCl at pH 7, 300 mM of NaCl and 5 mM of MNG3, to dissolve the cell membranes and obtain said Nox protein in suspension in the suitable solution,
purification of said Nox protein in suspension in the suitable solution, by affinity chromatography, with a buffer of 50 mM Tris pH7, 300 mM NaCl, 0.03 mM MNG3.

In an embodiment, the invention relates to a method as defined above, comprising, after said purification step, a step of size exclusion chromatography, in particular in a column, preferably using a buffer of 50 mM Tris HCl pH 7, 300 mM NaCl and 20 to 100 µM MNG3.

Preferably, the buffer used for the purification step contains 30 µM of MNG3.

In an embodiment, the invention relates to a method as defined above, comprising, after said step of size exclusion chromatography, a step of depletion of the detergent.

The step of depletion of the detergent makes it possible to remove the excess detergent from the Nox protein in an affinity column (or ion exchange column) Preferably, 10 column volumes are used for washing the surplus of MNG3, and elution is carried out with a buffer of 50 mM Tris HCl pH 7, 300 mM NaCl and 20 µM MNG3.

The Nox proteins of the invention can be expressed effectively in bacteria, with a high yield of the order of a milligram of pure, functional protein per litre of culture, which allows large-scale production at very low cost.

Another aspect of the invention relates to the use in vitro, ex vivo or in vivo of the Nox protein as defined above as a research tool for screening molecules of therapeutic interest. Besides their production in large quantity and their low production cost, the Nox proteins of the invention offer many advantages for screening molecules of therapeutic interest. Non-limitatively, the latter can for example be activated with NADPH alone, or an analogue of NADPH, and are practical for implementation, provided a one-component enzyme system is concerned.

In an embodiment, the invention relates to the above use in which said Nox protein is used in vitro.

In an embodiment, the invention relates to the above use in which said Nox protein is used ex vivo.

In an embodiment, the invention relates to the above use in which said Nox protein is used in vivo.

In an embodiment, the invention relates to the above use in which said Nox protein is used ex vivo or in vivo in humans In an embodiment, the invention relates to the above use in which said Nox protein is used ex vivo or in vivo in a non-human animal.

In an embodiment, the invention relates to the above use in which said Nox protein is not used ex vivo or in vivo in humans In an embodiment, the invention relates to the above use in which said Nox protein is not used ex vivo or in vivo in a non-human animal.

In a particular embodiment, the invention relates to the use of the Nox protein defined above, in which said Nox protein constitutes a model therapeutic target.

The Nox proteins of the invention constitute particularly interesting model proteins, all the more so as they are homologues of eukaryotic Nox proteins, and in particular of human Nox proteins. In fact, the similarity between SpNox and Nox2 is identical to the similarity between Nox2 and Nox5. The use of the Nox proteins of the invention for pre-screening or screening of molecules of therapeutic interest would therefore make it possible to increase the probability of identifying new drugs that are active for the eukaryotic Nox.

In a particular embodiment, the invention relates to the use of the Nox protein defined above, in which said protein is brought into contact with at least one molecule of therapeutic interest.

In an embodiment, the invention relates to the use of the Nox protein defined above, in which said Nox protein is adsorbed on a support, preferably from a polyhistidine tag present on said Nox protein.

In an embodiment, the invention relates to the use of the Nox protein defined above, in which said support is a plate, preferably a 96-well plate.

In a particular embodiment, the invention relates to the use of the Nox protein defined above, in which the NADPH oxidase activity of said Nox protein and/or the production of ROS is measured, in the presence or absence of said at least one molecule of therapeutic interest.

In an embodiment, the invention relates to the use of the Nox protein defined above for identifying molecules capable of modulating its NADPH oxidase activity.

In an embodiment, the invention relates to the use of the Nox protein defined above for identifying molecules capable of modulating its NADPH oxidase activity, said Nox protein being a prokaryotic protein.

In an embodiment, the invention relates to the use of the Nox protein defined above for identifying molecules capable of modulating the NADPH oxidase activity of another Nox protein.

In a particular embodiment, the invention relates to the use of a prokaryotic Nox protein as defined above, for identifying molecules capable of modulating the NADPH oxidase activity of a eukaryotic Nox protein.

In a particular embodiment, the invention relates to the use of the Nox protein defined above for screening molecules capable of modulating the production of ROS by said Nox protein or by another Nox protein.

In a particular embodiment, the invention relates to the use of the Nox protein defined above for screening molecules capable of reducing or inhibiting the production of ROS by said Nox protein or by another Nox protein.

In a particular embodiment, the invention relates to the use of the Nox protein defined above for screening molecules capable of stimulating the production of ROS by said Nox protein or by another Nox protein.

In a particular embodiment, the invention relates to the use of the Nox protein defined above for screening molecules capable of having antibiotic properties.

Identification of molecules capable of stimulating the production of ROS by a bacterial Nox may also allow potentiation of known antibiotics. In fact, the endogenous production of ROS in the bacterium may have the consequence of making resistant bacteria sensitive to antibiotics.

Such molecules that increase the production of ROS by the NOX may thus be used in combination with an antibiotic for treating certain bacterial infections.

In other words, a molecule that activates a prokaryotic Nox protein is capable of leading to the production of ROS when it is administered to a bacterium and, consequently, is capable of constituting an effective antibacterial molecule.

Another aspect of the invention relates to the use in vitro, ex vivo or in vivo:
- of a nucleic acid coding for a Nox protein as defined above,
- of an expression vector containing said nucleic acid, or
- of a cell containing said expression vector, as a research tool for screening molecules of therapeutic interest.

In an embodiment, the invention relates to the above use in which said nucleic acid, said expression vector or said cell is used in vitro.

In an embodiment, the invention relates to the above use in which said nucleic acid, said expression vector or said cell is used ex vivo.

In an embodiment, the invention relates to the above use in which said nucleic acid, said expression vector or said cell is used in vivo.

In an embodiment, the invention relates to the above use in which said nucleic acid, said expression vector or said cell is used ex vivo or in vivo in humans.

In an embodiment, the invention relates to the above use in which said nucleic acid, said expression vector or said cell is used ex vivo or in vivo in a non-human animal.

In an embodiment, the invention relates to the above use in which said nucleic acid, said expression vector or said cell is not used ex vivo or in vivo in humans In an embodiment, the invention relates to the above use in which said nucleic acid, said expression vector or said cell is not used ex vivo or in vivo in a non-human animal.

In another aspect, the invention relates to a method for identifying, from a bank of molecules to be tested, at least one molecule capable of modifying the production of ROS by a eukaryotic Nox protein, comprising:
- a step a) in which said molecules to be tested are screened, by being brought into contact with a prokaryotic Nox protein, for selecting the molecules capable of modifying the production of ROS by the prokaryotic Nox protein, then
- a step b) in which said molecules capable of modifying the production of ROS by the prokaryotic Nox protein are brought into contact with the eukaryotic Nox protein, for identifying at least one molecule capable of modifying the production of ROS by the eukaryotic Nox protein.

As the prokaryotic Nox proteins can be produced on a large scale and at low cost, it is beneficial to use them for testing and pre-selecting molecules that are capable of acting on the eukaryotic Nox proteins, the latter being more difficult to produce in sufficient quantities.

In an embodiment, the production of ROS by said prokaryotic Nox protein in step a), and/or by said eukaryotic Nox protein in step b), is determined by measuring absorbance by spectrophotometry, and in particular by a colorimetric assay, by chemiluminescence or by fluorescence.

In an embodiment, steps a) and b) are carried out in plates, preferably 96-well plates.

In an embodiment, step a) is carried out in plates, preferably 96-well plates, and step b) is carried out in a spectrophotometry cell.

In an embodiment, step a) is carried out in a spectrophotometry cell and step b) is carried out in plates, preferably 96-well plates.

In another aspect, the invention relates to the use of the motif:

(SEQ ID NO: 2)
[P/A/S/E/F]-H-[P/S/A]-F-[T/S]-[L/I/M/V]

for identifying an amino acid sequence capable of encoding a Nox protein.

In another aspect, the invention relates to the use of the motif:

(SEQ ID NO: 4)
G-[I/S/V/L]-G-[V/I/A/F]-[T/A/S]-[P/Y/T/A]

for identifying an amino acid sequence capable of encoding a Nox protein.

In another aspect, the invention relates to the use of the motif:

(SEQ ID NO: 2)
[P/A/S/E/F]-H-[P/S/A]-F-[T/S]-[L/I/M/V]

and the motif:

(SEQ ID NO: 4)
G-[I/S/V/L]-G-[V/I/A/F]-[T/A/S]-[P/Y/T/A]

for identifying an amino acid sequence capable of encoding a Nox protein.

Another aspect of the invention also relates to a method for identifying a Nox protein comprising:
a) a step of detecting, in an amino acid sequence, an NADPH motif comprising the following sequence:

G-[I/S/V/L]-G-[V/I/A/F]-[T/A/S]-[P/Y/T/A]    (SEQ ID NO: 4), and b) a step of detecting, in said amino acid sequence, an FAD motif comprising the following sequence:

H-[P/S/A]-F-[T/S]-[L/I/M/V]    (SEQ ID NO: 6), and
in which, if said amino acid sequence comprises said NADPH motif from step a) and said FAD motif from step b), then said amino acid sequence is capable of encoding a Nox protein.

In an embodiment, the invention also relates to a method for identifying in silico a Nox protein comprising:

a) a step of detecting, in an amino acid sequence, an NADPH motif comprising the following sequence:

G-[I/S/V/L]-G-[V/I/A/F]-[T/A/S]-[P/Y/T/A]    (SEQ ID NO: 4), and b) a step of detecting, in said amino acid sequence, an FAD motif comprising the following sequence:

H-[P/S/A]-F-[T/S]-[L/I/M/V]    (SEQ ID NO: 6), and
in which, if said amino acid sequence comprises said NADPH motif from step a) and said FAD motif from step b), then said amino acid sequence is capable of encoding a Nox protein.

In a particular embodiment, the invention relates to a method of identification as defined above, further comprising:

c) a step of detecting, in said amino acid sequence, 3 to 7 regions capable of forming transmembrane helices, in particular with the aid of the TMHMM software, and
d) a step of detecting, in said amino acid sequence, at least 2 bis-histidyl motifs separated by at least 20 amino acids, each of the bis-histidyl motifs being constituted by 2 histidine residues separated by 12, 13 or 14 amino acid residues, and in which, if said amino acid sequence comprises said 3 to 7 regions capable of forming transmembrane helices and said at least 2 bis-histidyl motifs, then said amino acid sequence is capable of encoding a Nox protein.

In a particular embodiment, the invention relates to a method of identification as defined above, in which said FAD motif from step b) comprises the sequence:

[P/A/S/E/F]-H-[P/S/A]-F-[T/S]-[L/I/M/V].    (SEQ ID NO: 2)

In a particular embodiment, the invention relates to a method of identification as defined above, comprising a step of detecting, in said amino acid sequence, an additional motif S1:

[G/S/A]-[Q/D]-F-[A/V/T/L/F]-[F/Y/W/L/R]-[L/V/I/F/W]    (SEQ ID NO: 1), and
in which, if said amino acid sequence comprises said additional motif S1, then said amino acid sequence is capable of encoding a Nox protein.

In a particular embodiment, the invention relates to a method of identification as defined above, comprising a step of detecting, in said amino acid sequence, an additional motif S2:

[K/R]-X-X-G-[D/G]-X-[T/S]    (SEQ ID NO: 3), and
in which, if said amino acid sequence comprises said additional motif S2, then said amino acid sequence is capable of encoding a Nox protein.

In a particular embodiment, the invention relates to a method of identification as defined above, in which said amino acid sequence is encoded by a nucleotide sequence present on a bacterial genome.

In a particular embodiment, the invention relates to a method as defined above comprising:

a step a) of detecting, in an amino acid sequence, an NADPH motif comprising the following sequence:

G-[I/S/V/L]-G-[V/I/A/F]-[T/A/S]-[P/Y/T/A]    (SEQ ID NO: 4), and a step b) of detecting, in said amino acid sequence, an FAD motif comprising the following sequence:

H-[P/S/A]-F-[T/S]-[L/I/M/V]    (SEQ ID NO: 6), and a step c) of detecting, in said amino acid sequence, 3 to 7 regions capable of forming transmembrane helices, in particular with the aid of the TMHMM software, and
a step d) of detecting, in said amino acid sequence, at least 2 bis-histidyl motifs, each of the bis-histidyl motifs constituted by 2 histidine residues separated by 12, 13 or 14 amino acid residues, said bis-histidyl motifs being separated by 20 amino acids, in which, if said amino acid sequence comprises said NADPH motif from step a), said FAD motif from step b), said 3 to 7 regions capable of forming transmembrane helices from step c) and said at least 2 bis-histidyl motifs from step d), then said amino acid sequence is capable of encoding an NADPH oxidase protein.

In another aspect, the invention relates to a method for identifying a prokaryotic Nox protein comprising:

a step a) of detecting, in an amino acid sequence, an NADPH motif comprising the following sequence:

G-[I/S/V/L]-G-[V/I/A/F]-[T/A/S]-[P/Y/T/A]    (SEQ ID NO: 4), and a step b) of detecting, in said amino acid sequence, an FAD motif comprising the following sequence:

[P/A/S/E/F]-H-[P/S/A]-F-[T/S]-[L/I/M/V]    (SEQ ID NO: 2), and a step c) of detecting, in said amino acid sequence, 3 to 7 regions capable of forming transmembrane helices, in particular with the aid of the TMHMM software, and
a step d) of detecting, in said amino acid sequence, at least 2 bis-histidyl motifs, each of the bis-histidyl motifs being constituted by 2 histidine residues separated by 12, 13 or 14 amino acid residues, said bis-histidyl motifs being separated by 20 amino acids, and
a step e) of detecting, in said amino acid sequence, an additional motif S1:

[G/S/A]-[Q/D]-F-[A/V/T/L/F]-[F/Y/W/L/R]-[L/V/I/F/W]    (SEQ ID NO: 1), and a step f) of detecting, in said amino acid sequence, a second additional motif S2:

[K/R]-X-X-G-[D/G]-X-[T/S]    (SEQ ID NO: 3)

in which, if said amino acid sequence comprises said NADPH motif from step a), said FAD motif from step b), said 3 to 7 regions capable of forming transmembrane helices from step c), said at least 2 bis-histidyl motifs from step d), the additional motif S1 from step e) and the additional motif S2 from step f), then said amino acid sequence is capable of encoding a prokaryotic Nox protein.

In an embodiment, the invention relates to a method for identifying in silico a prokaryotic Nox protein comprising:

a step a) of detecting, in an amino acid sequence, an NADPH motif comprising the following sequence:

G-[I/S/V/L]-G-[V/I/A/F]-[T/A/S]-[P/Y/T/A]    (SEQ ID NO: 4), and a step b) of detecting, in said amino acid sequence, an FAD motif comprising the following sequence:

[P/A/S/E/F]-H-[P/S/A]-F-[T/S]-[L/I/M/V]     (SEQ ID NO: 2), and a step c) of detecting, in said amino acid sequence, 3 to 7 regions capable of forming transmembrane helices, in particular with the aid of the TMHMM software, and a step d) of detecting, in said amino acid sequence, at least 2 bis-histidyl motifs, each of the bis-histidyl motifs being constituted by 2 histidine residues separated by 12, 13 or 14 amino acid residues, said bis-histidyl motifs being separated by 20 amino acids, and a step e) of detecting, in said amino acid sequence, an additional motif S1:

[G/S/A]-[Q/D]-F-[A/V/T/L/F]-[F/Y/W/L/R]-[L/V/I/F/W]     (SEQ ID NO: 1), and a step f) of detecting, in said amino acid sequence, a second additional motif S2:

[K/R]-X-X-G-[D/G]-X-[T/S]     (SEQ ID NO: 3)

in which, if said amino acid sequence comprises said NADPH motif from step a), said FAD motif from step b), said 3 to 7 regions capable of forming transmembrane helices from step c), said at least 2 bis-histidyl motifs from step d), the additional motif S1 from step e) and the additional motif S2 from step f), then said amino acid sequence is capable of encoding a prokaryotic Nox protein.

Another aspect of the invention finally relates to the use of a detergent from the maltoside family for solubilization of Nox proteins.

In another embodiment, the invention relates to the use of a detergent from the maltoside family for solubilization of Nox proteins, said detergent preferably being selected from the group of dodecyl-maltosides.

In another embodiment, the invention relates to the use of a detergent from the maltoside family for solubilization of Nox proteins, said detergent preferably being selected from the group constituted by:

n-Dodecyl-β-D-Maltopyranoside,
n-Decyl-α-D-Maltopyranoside,
2,6-Dimethyl-4-Heptyl-β-D-Maltopyranoside,
HEGA-11,
n-Hexyl-β-D-Maltopyranoside,
n-Hexadecyl-β-D-Maltopyranoside,
n-Nonyl-β-D-Maltopyranoside,
n-Octyl-β-D-Maltopyranoside,
2-Propyl-1-Pentyl-β-D-Maltopyranoside,
n-Tetradecyl-β-D-Maltopyranoside,
n-Tridecyl-β-D-Maltopyranoside,
n-Undecyl-β-D-Maltopyranoside,
n-Undecyl-α-D-Maltopyranoside,
ω-Undecylenyl-β-D-Maltopyranoside,
n-Decyl-β-D-Thiomaltopyranoside,
n-Dodecyl-β-D-Thiomaltopyranoside,
n-Octyl-β-D-Thiomaltopyranoside,
n-Nonyl-β-D-Thiomaltopyranoside,
n-Undecyl-β-D-Thiomaltopyranoside,
Lauryl Maltose Neopentyl Glycol (MNG3),
Decyl Maltose Neopentyl Glycol,
CYMAL-5 Neopentyl Glycol,
CYMAL-6 Neopentyl Glycol,
CYMAL-7 Neopentyl Glycol,
CYMAL-1,
CYMAL-2,
CYMAL-3,
CYMAL-4,
CYMAL-5,
CYMAL-6,
CYMAL-7,
Octyl Maltoside, Fluorinated,
BisMalt-18,
BisMalt-20,
BisMalt-22,
BisMalt-24,
BisMalt-28,
n-Dodecyl-d25-β-D-Maltopyranoside,
Decyl-β-D-Selenomaltoside,
Dodecyl-β-D-Selenomaltoside,
Octyl-β-D-Selenomaltoside, and
Undecyl-β-D-Selenomaltoside.

DETAILED DESCRIPTION

Examples

Example 1: Identification of the Nox Proteins from the Sequences in the Databases The program used for identifying the Nox sequences from the bacterial genomes was written in Python 3.0. This program is based on the use of 3 complementary filters.

The first 2 filters select the sequences containing the motifs G[I/S/V/L]G[V/I/A/F][T/A/S][P/Y/T/A] (SEQ ID NO: 4) (NADPH-binding domain) and H[P/S/A]F[T/S][L/I/M/V] (SEQ ID NO: 6) (FAD-binding domain), defined on the basis of the sequences of the 48 most similar proteins relative to human Nox2 protein (Uniprot code: P04839). The sequences of the 48 proteins were identified by performing a BlastP search on the public databases.

The third filter selects the sequences that contain the 4 histidine residues responsible for coordinating the 2 haem parts of the cytochrome b motif. Thus, a search is carried out for 2 bis-histidyl motifs separated by at least 20 amino acids (i.e. the size of a transmembrane helix), each of the bis-histidyl motifs being constituted by 2 histidine residues separated by 12, 13 or 14 amino acid residues. The TMHMM software was used for locating the transmembrane a helices. Sequences with more than 7 predicted a helices (i.e. the number of helices found in Duox1-2) were not retained, whereas the sequences with at least 3 predicted a helices were selected to take account of possible errors of prediction.

The multiple alignments of the sequences of Nox proteins identified were carried out using the Clustal Omega software, performing 2 iterations.

Figure 1:
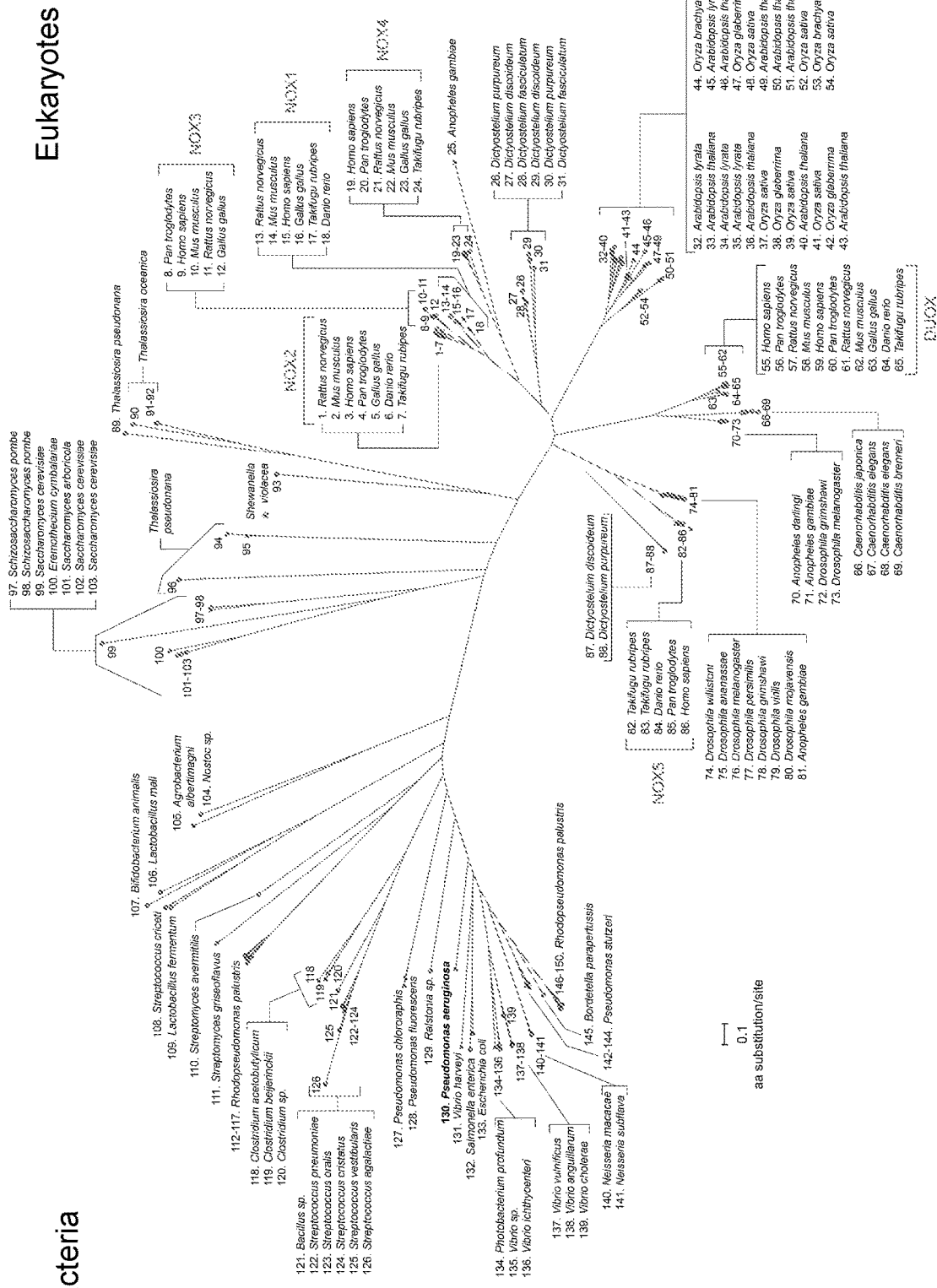
FIG. 1. Phylogenetic tree of the Nox proteins.
Figure 2A:
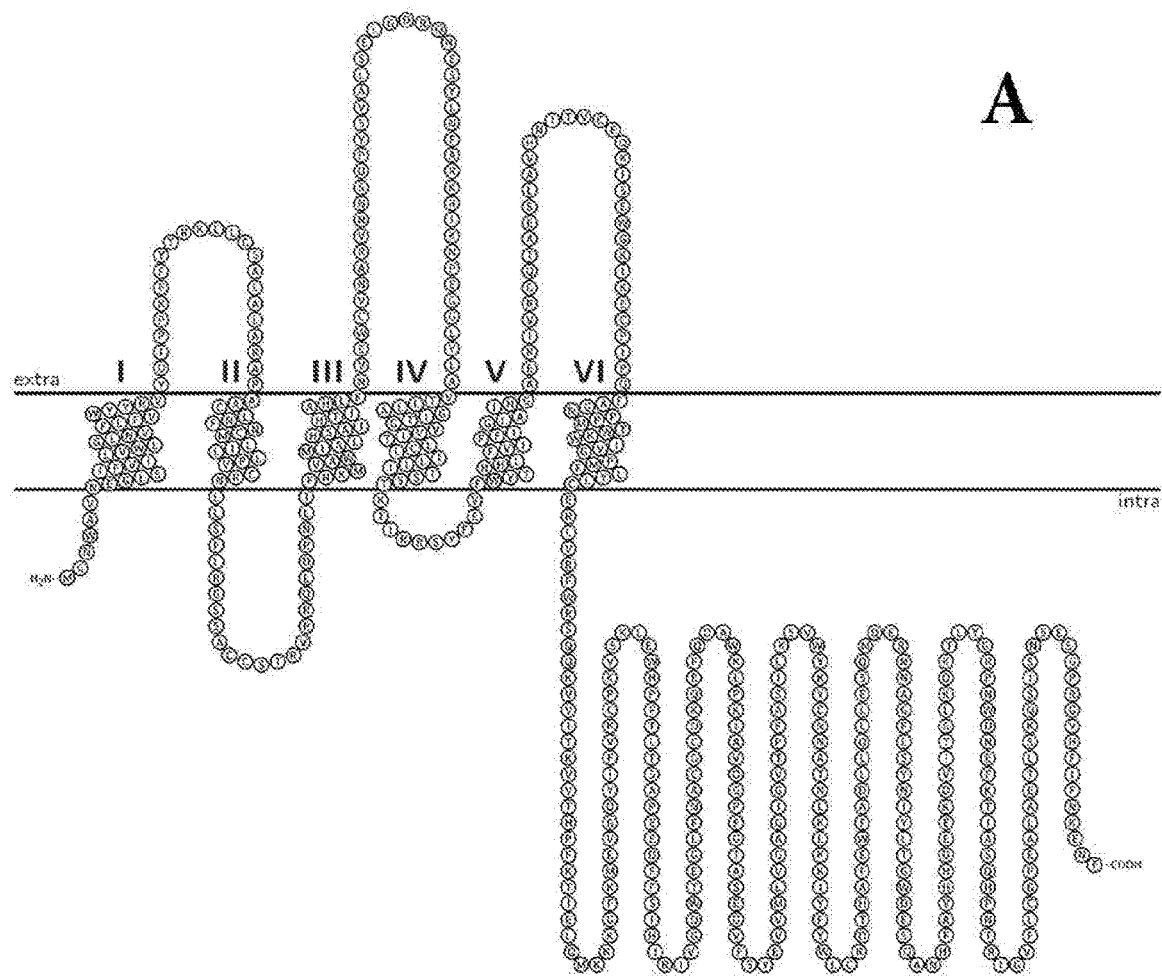
FIG. 2. Diagrammatic representation of the proteins Nox2 (human Nox; SEQ ID NO:370) (A), SpNox (*Streptococcus pneumoniae*; SEQ ID NO:24) (B), Pallox (*Pseudomonas aeruginosa* SEQ ID NO:25) (C), and EcNox (*Escherichia coli*; SEQ ID NO:26) (D).
Figure 2:
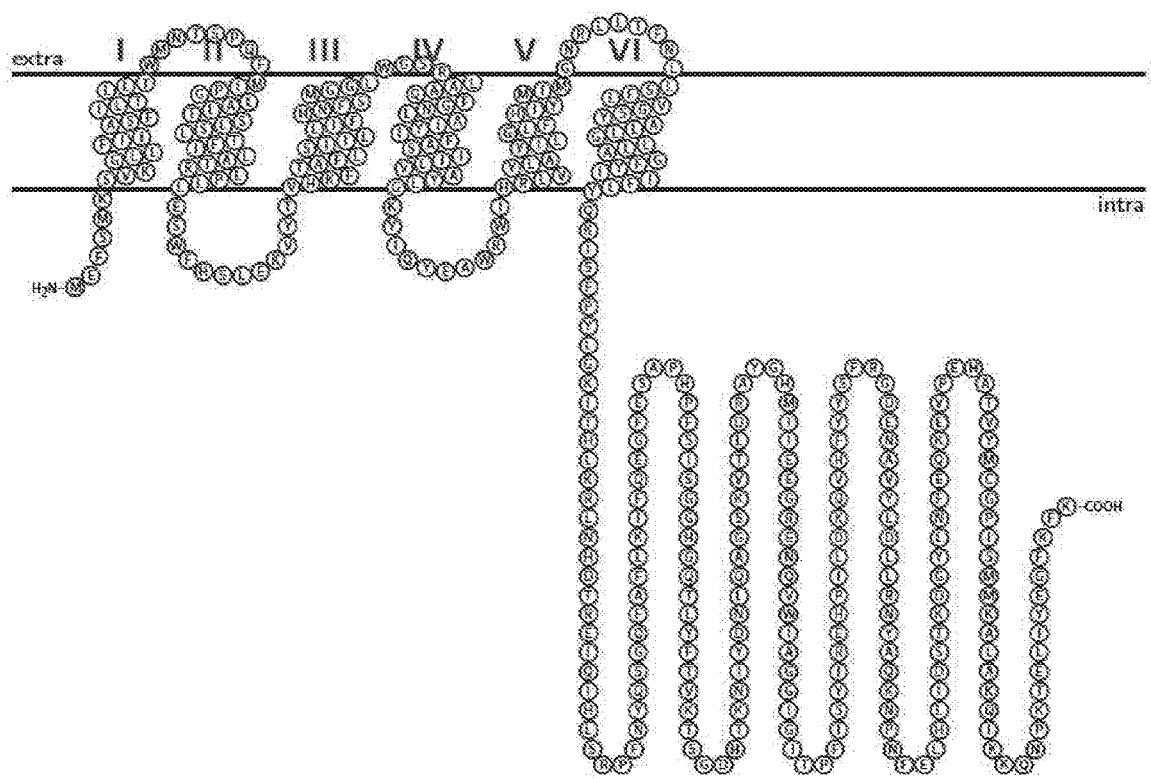
Figure 2:
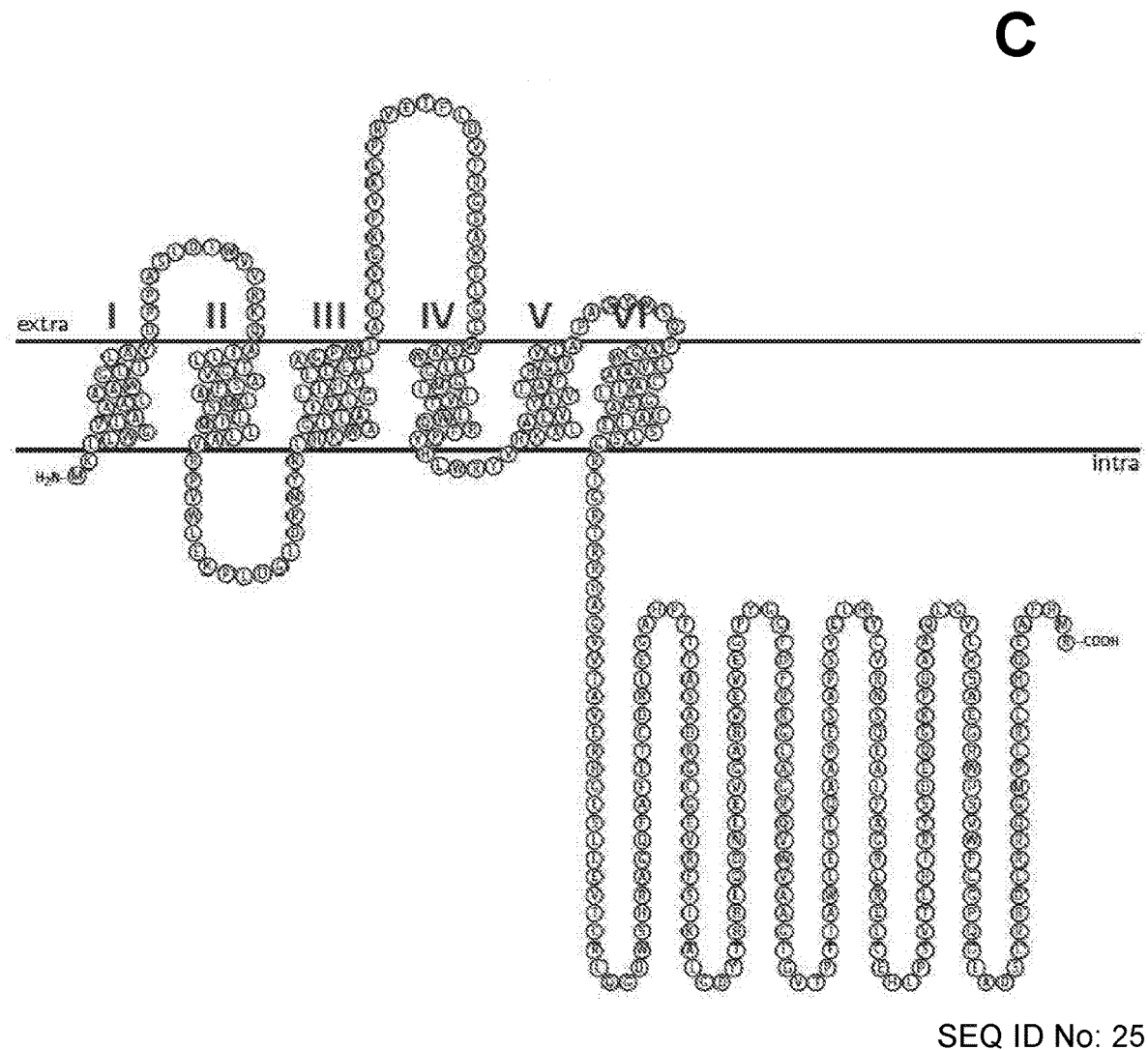
Figure 2:
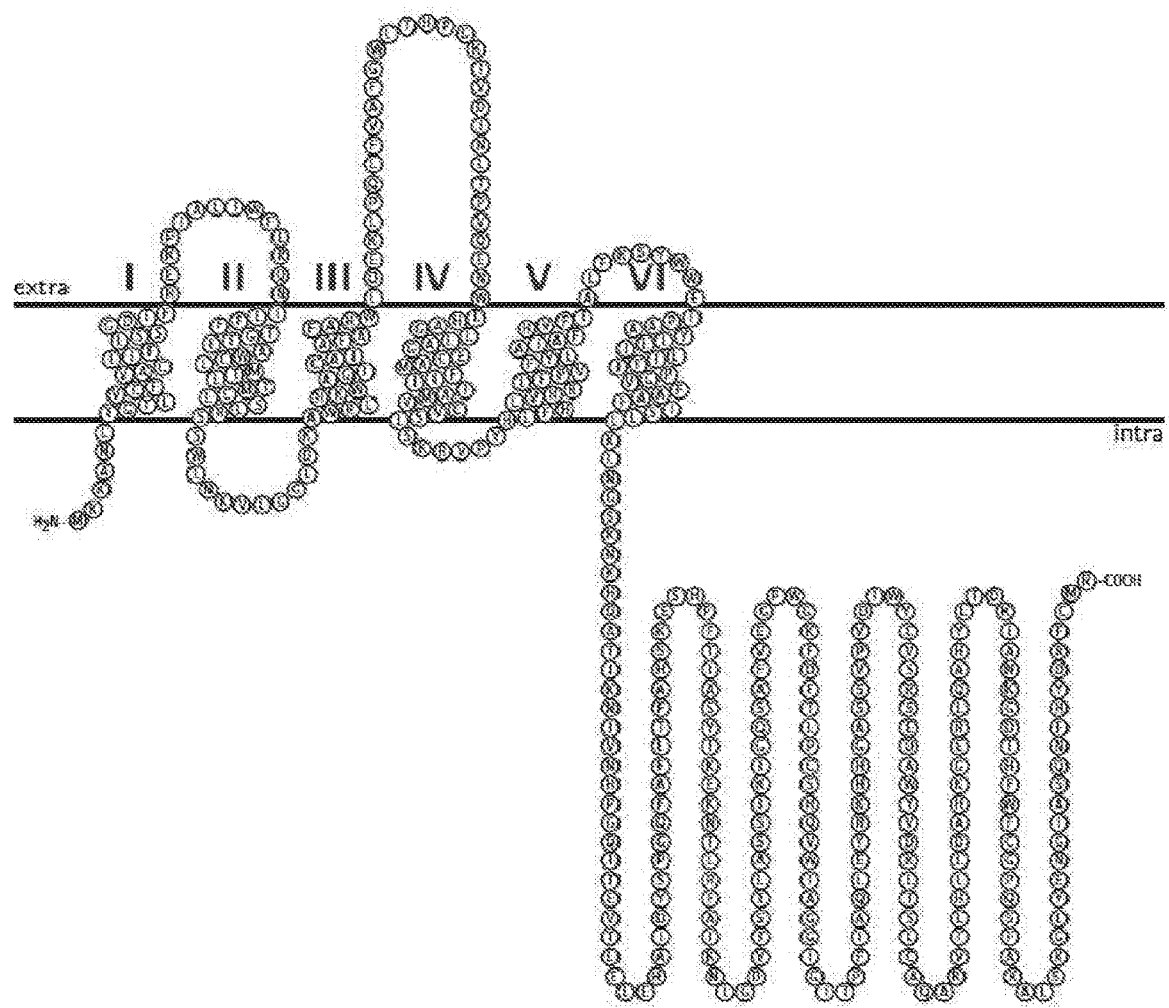

A phylogenetic tree was constructed using the PhyML 3.0 software based on the sequences of 150 putative Nox proteins (FIG. 1).

Example 2: Preparation of the Nox Protein Identified in *Streptococcus Pneumoniae* (SpNOX)

The gene coding for the protein SpNox (Uniprot code #Q8CZ28) from *Streptococcus pneumoniae* R6 (taxonomic identifier #171101) was synthesized and optimized for heterologous expression in *Escherichia coli*. Bases coding for a polyhistidine tag as well as a thrombin digestion site were added on the 5' end of the complementary DNA encoding SpNox.

Translation of the gene introduces 18 amino acids on the amino-terminal end of the protein before digestion by thrombin and only 4 amino acids (GSRS) afterwards. The gene thus modified was cloned into the pUC57 vector.

In order to produce the protein in large quantities, the modified gene was inserted in the pQlinkN expression vector between the NotI and BamHI restriction sites under the control of a tac promoter, inducible with IPTG (isopropyl β-D-1-thiogalactopyranoside), and this vector also carries an ampicillin resistance gene. The vector was introduced by transformation by thermal shock into a chloramphenicol-resistant strain of *Escherichia coli* BL21 (DE3) pLysS (phenotype: F− ompT hsdSB ($r_B^- m_B^-$) gal dcm (DE3) pLysS ($Cam^R$)). The bacteria were then immediately cultured for 1 h at 37° C. in LB (Luria Bertani) medium without selection pressure. A fraction of this culture was then spread on a Petri dish and incubated overnight at 37° C.

Figure 3:
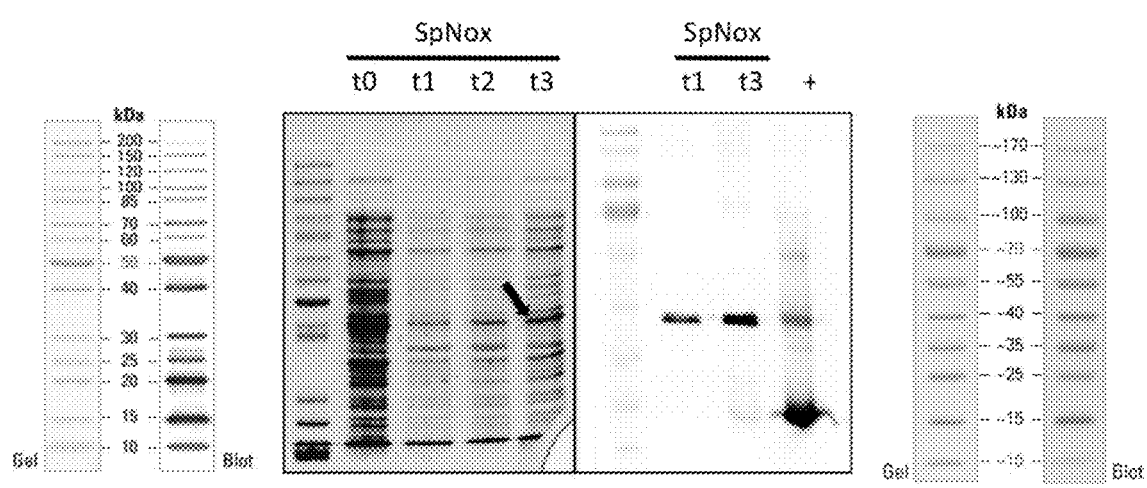
FIG. 3. Analysis by SDS-PAGE 10% acrylamide with Coomassie Blue staining (on the left) and Western-blot immuno-detected by an antibody directed against the polyhistidine tag of spNOX (on the right). t0, t1, t2 and t3: Total extracts before induction, after 1 h, 2 h and 3 h. +: positive control.

Starting from a single colony, a culture was started in liquid medium in the presence of chloramphenicol (34 µg/ml) and ampicillin (100 µg/ml) at 37° C., with stirring overnight. The culture was inoculated from the pre-culture at dilution to 1/20th of the final volume. The culture was placed at 37° C. in an orbital stirrer with a speed of 180 rpm. The optical density of the medium was monitored at 600 nm until a value of 1.5 was reached. Overexpression of the SpNOX protein was induced by adding a concentration of 0.1 mM of IPTG to the medium for 4 h at 210 rpm. At the end of culture, the bacteria were collected by centrifugation at low speed (7000 g, 30 minM, 4° C.) and were stored at −80° C. The expression level of the SpNOX protein was then monitored by SDS-PAGE analysis and confirmed by Western blot (FIG. 3).

The bacterial pellet was taken up in a buffer of 50 mM Tris HCl at pH 7, 250 mM NaCl and 10% glycerol, to which a cocktail of anti-proteases (complete ULTRA Tablets, EDTA-free, Roche Applied Science) was added, as well as DNase at a concentration of 10 µg/ml (Sigma-Aldrich). The cells were lysed mechanically using a microfluidizer (M-1105, Microfluidics, USA) at 1400 Psi in 5 successive passes.

Visual monitoring of sample viscosity is important in this step. The unlysed bacteria, the cellular debris and the inclusion bodies were separated by centrifugation at low speed (8000 g, 20 min, 4° C.). The supernatant was centrifuged at very high speed for 1 h at 250000 g, at 4° C. The pellet was taken up in a buffer of 50 mM Tris pH7 and the total protein concentration was determined by the BCA (bicinchoninic acid assay) technique and the absorbance was measured at 562 nm according to the protocol provided by the supplier (Sigma-Aldrich). The sample was stored at −80° C. at a concentration of 20 mg/ml of total protein.

Figure 4:
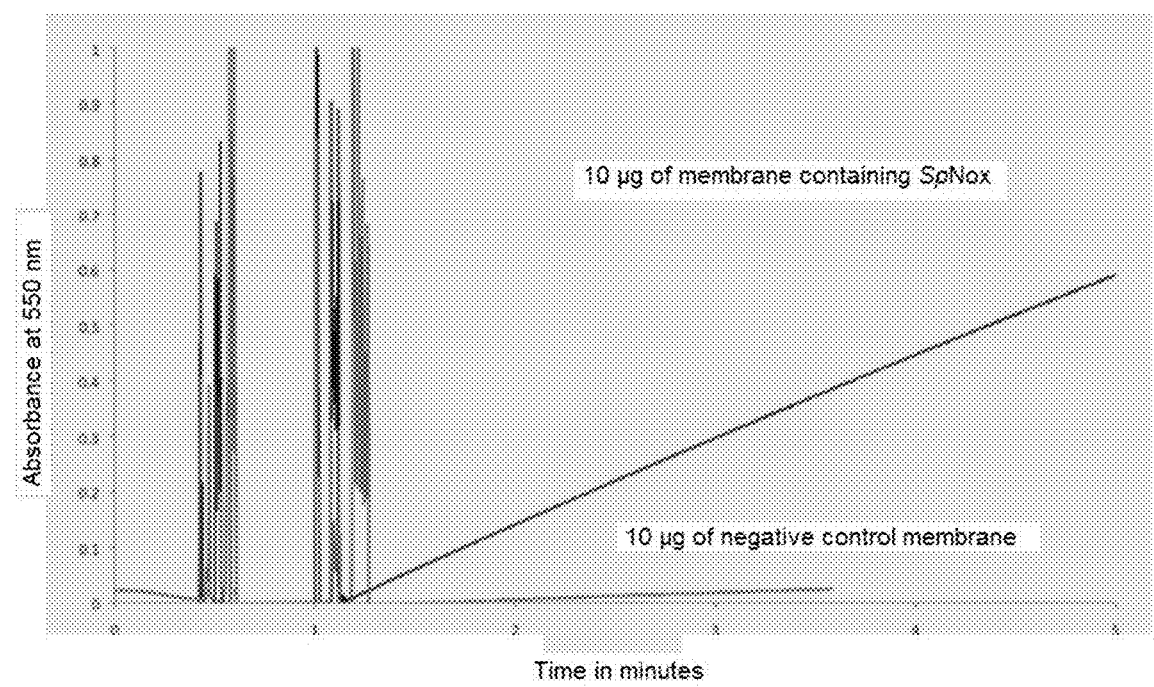
FIG. 4. Activity test on 10 μg of total membrane proteins. The transfer of electrons from NADPH, the substrate of SpNox (Nox protein from *Streptococcus pneumoniae*), to FAD, its cofactor, then to the haems and to the oxygen, as final acceptor, makes it possible to produce reactive oxygen species (ROS). These ROS will reduce cytochrome c, which will then absorb at 550 nm.

The SpNox activity was tested in this step in order to check its integrity after the lysis step (FIG. 4). This experiment is based on monitoring the reduction of cytochrome c by the superoxide ions produced by SpNox, according to the protocol available in the publication by Green et al. (Green T R, Wu D E. Detection of NADPH diaphorase activity associated with human neutrophil NADPH-O2 oxidoreductase activity. FEBS Lett. 1985 Jan. 1; 179(1):82-6).

The membranes were dissolved in a buffer of 50 mM Tris HCl at pH 7, 300 mM NaCl and 5 mM of MNG3 (lauryl Maltose NeoPentyl Glycol—NG310-MNG—Affymetrix) to a final concentration of 0.5 mg/ml of total protein. Ni-NTA Sepharose High performance resin (GE Healthcare Life Sciences), initially equilibrated in the same solubilization buffer, was added to the sample to a concentration of 1 ml of resin to 15 mg of protein. The whole was incubated with stirring at 4° C. overnight.

The resin loaded with the protein was deposited on a gravity column until the filtrate had flowed away completely. Several washing operations were carried out with a buffer of 50 mM Tris HCl pH7, 300 mM NaCl, 50 µM MNG3 and 50 mM imidazole until the absorbance at 280 nm had stabilized. A plateau at 300 mM of imidazole makes it possible to elute the protein by spreading the retentate at 3 to 5 ml.

Figure 5:
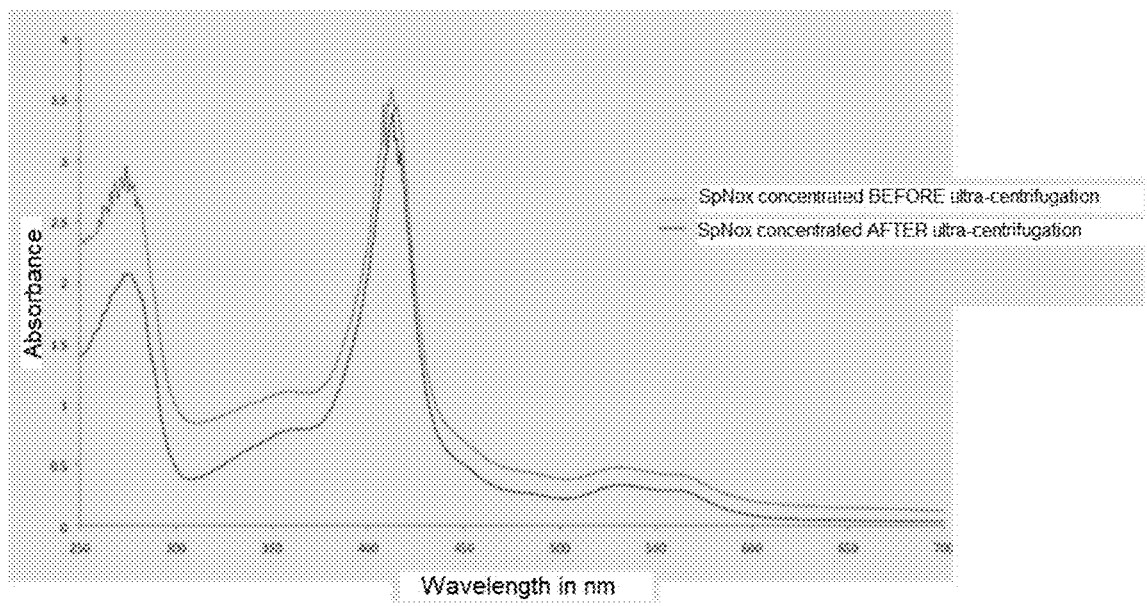
FIG. 5. Spectrophotometry measurement between 250 and 700 nm. The presence of the haems in the protein induces a characteristic signature with a peak at 410 nm Centrifugation at very high speed makes it possible to remove aggregates present in the sample. The peak at 280 nm decreases, but not that at 410 nm FIG. 6. A) Monitoring the purification of SpNox on affinity columns and gel filtration by SDS-PAGE 10% acrylamide with Coomassie Blue staining. Std: molecular weight standard (KDa), M: membrane, FT: Flow through, L: washing, E: Elution, A: Gel filtration, C1: 2 μg of SpNox, C2: 3 μg of SpNox, C3: 6 μg of SpNox. B) MALDI-TOF MS, spectrum of purified SpNox. The sample was concentrated to 3 mg/ml and diluted in an SA matrix.
Figure 6:
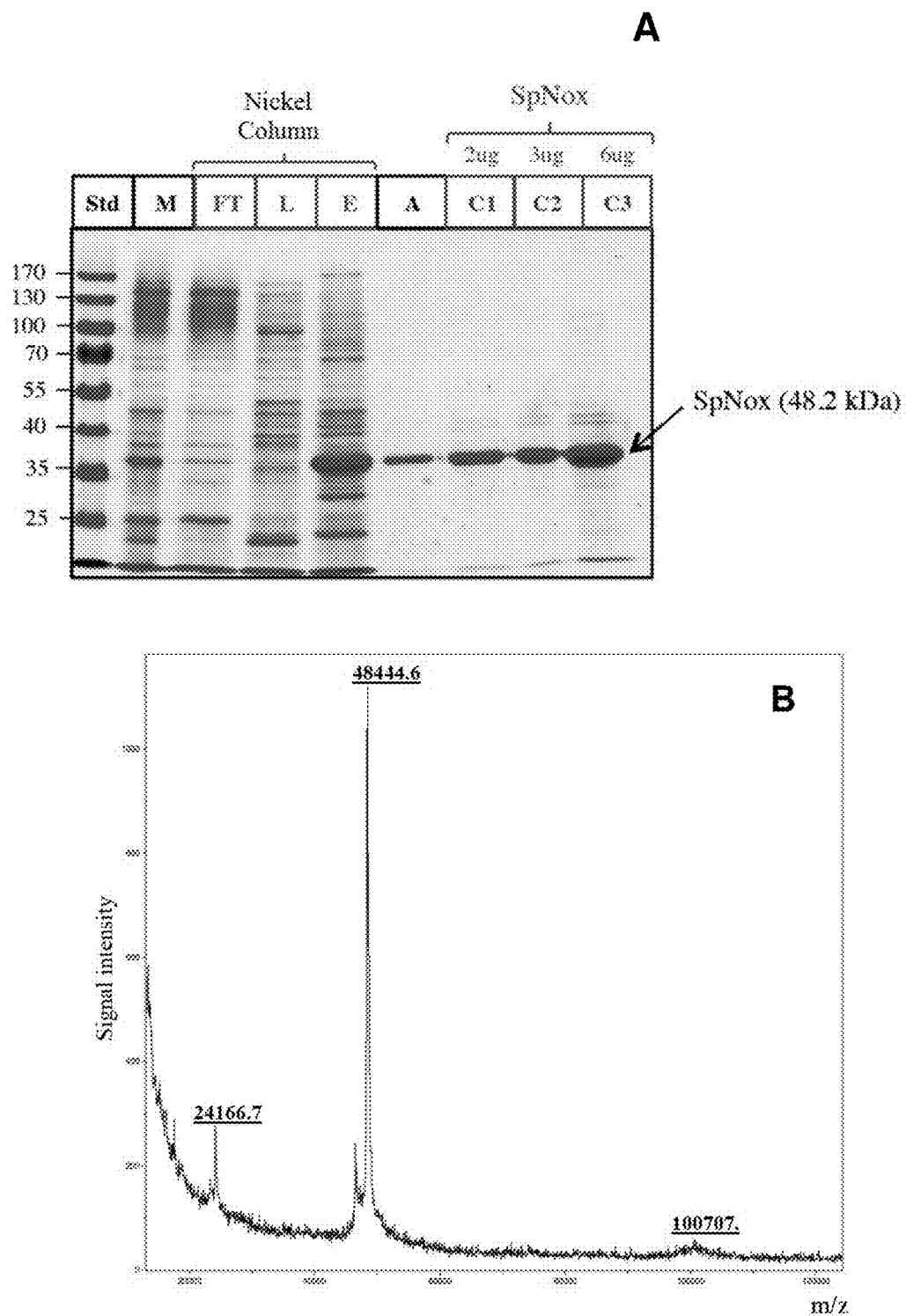

The spectral signature of the various fractions was evaluated between 200 and 700 nm and purification was monitored by SDS-PAGE. The purest fractions were combined and were concentrated by membrane filtration with a size limit of 30 kDa (Amicon® Ultra-4-5 Millipore). The sample thus prepared was centrifuged at high speed, 150000 g, for 20 minutes at 4° C. The yield and the quality of purification were evaluated by spectroscopy (FIG. 5) and SDS-PAGE (FIG. 6).

In order to perfect the purification of SpNox, a step of size exclusion chromatography is necessary. For this, a Superdex 200 10/300 GL column (GE Healthcare Life Sciences) was used with a mobile phase constituted by a buffer of 50 mM Tris HCl pH 7, 300 mM NaCl and 50 µM MNG3. Elution is monitored by absorbance at 280 nm using a system of the AKTA FPLC type (GE Healthcare Life Sciences). The purity of the protein was analysed by SDS-PAGE and mass spectrometry (FIG. 6).

Figure 7:
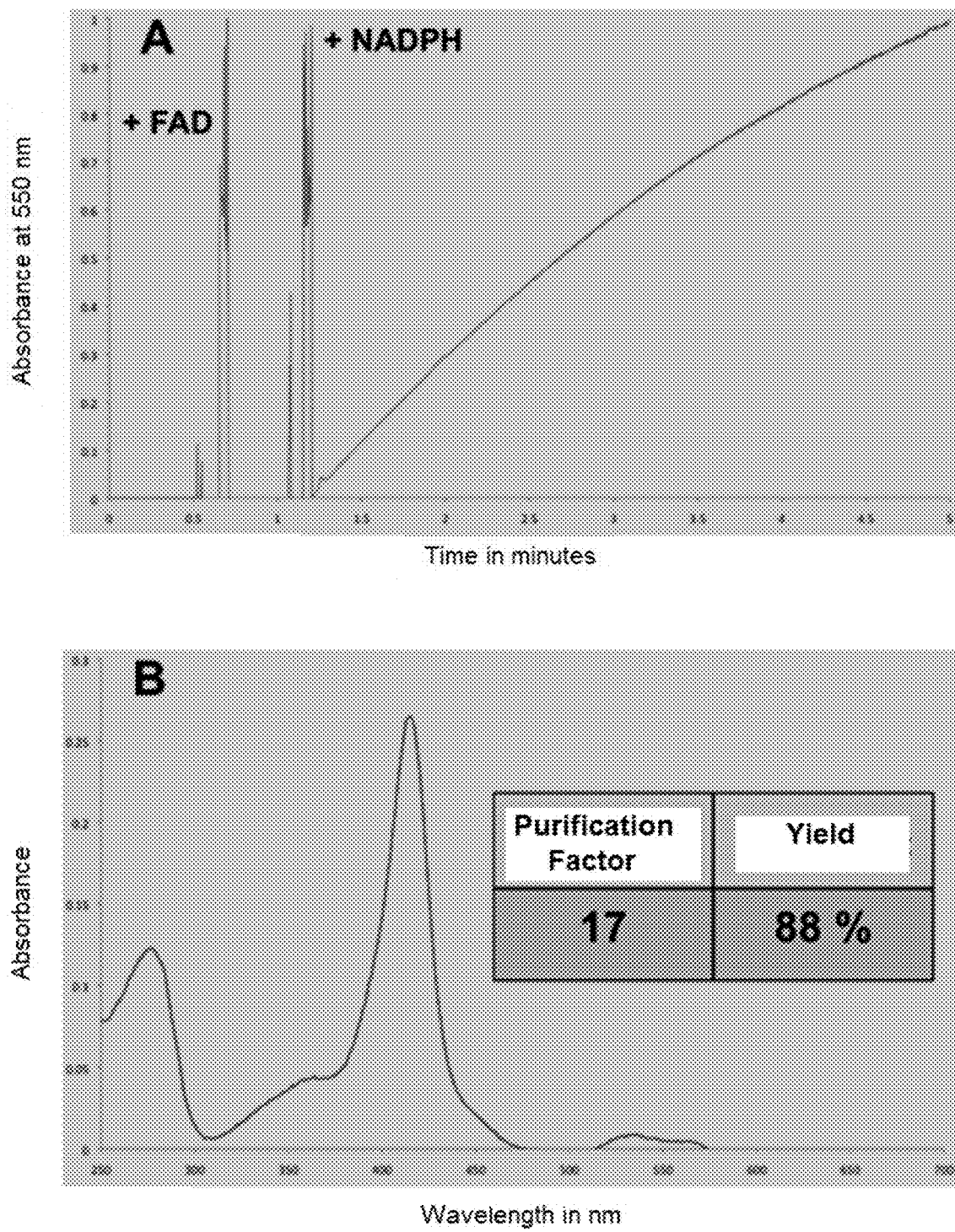
FIG. 7. A) Activity of 1 μg of SpNox. B) Spectrum of the pure protein between 250 and 700 nm.
Figure 8:
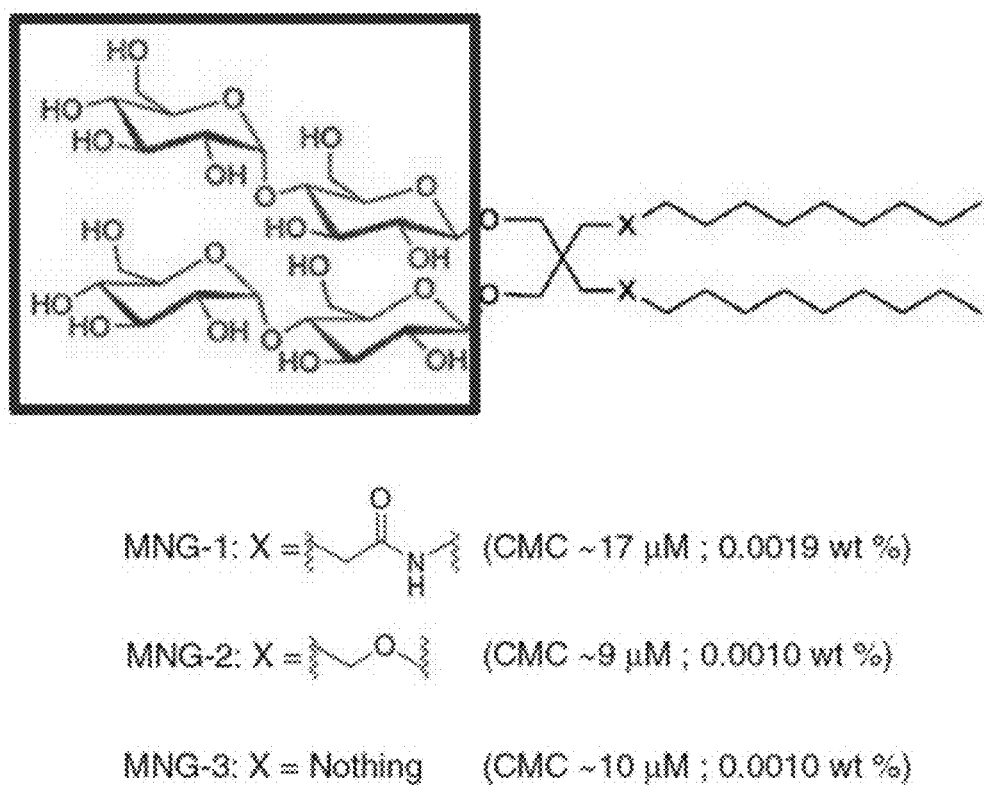
FIG. 8. A) Representation of MNG3 with the carbohydrate heads within the frame. B) Interferogram of concentrated SpNox at 3 mg/mL before and after depletion of MNG3. The signal of the maltose heads is between 980 and 1150 cm$^{-1}$.
Figure 8:
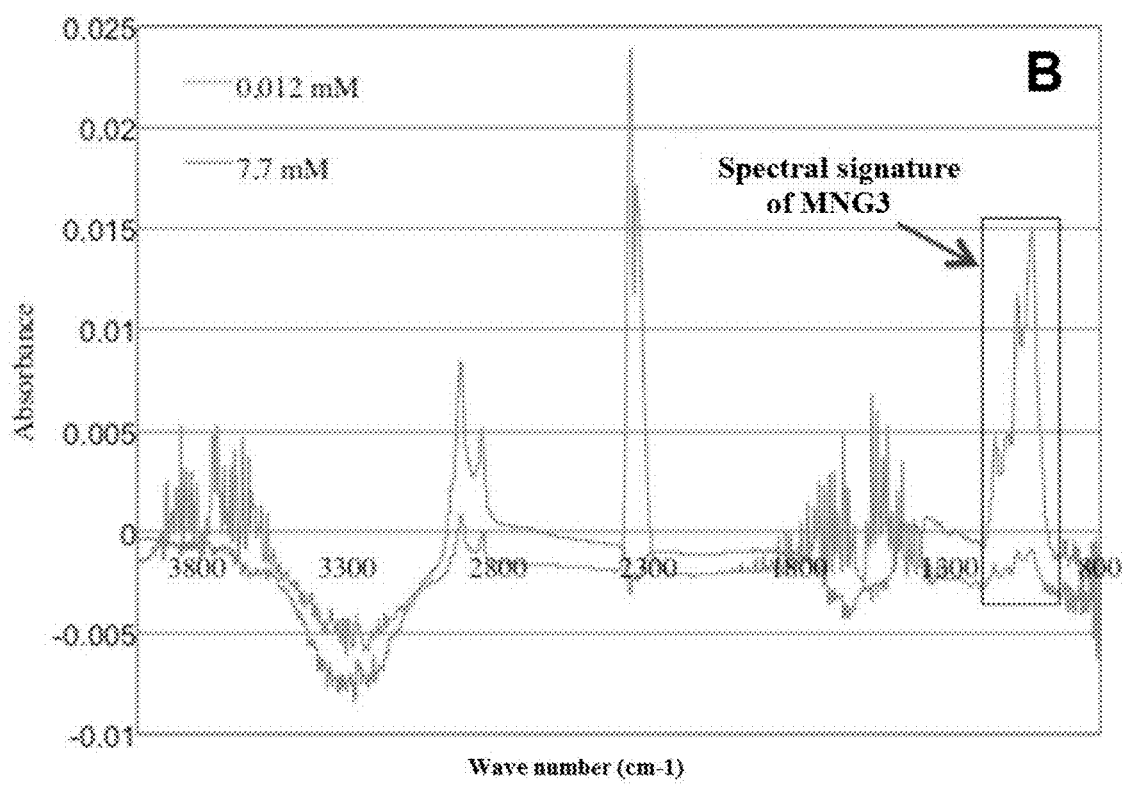
Figure 9:
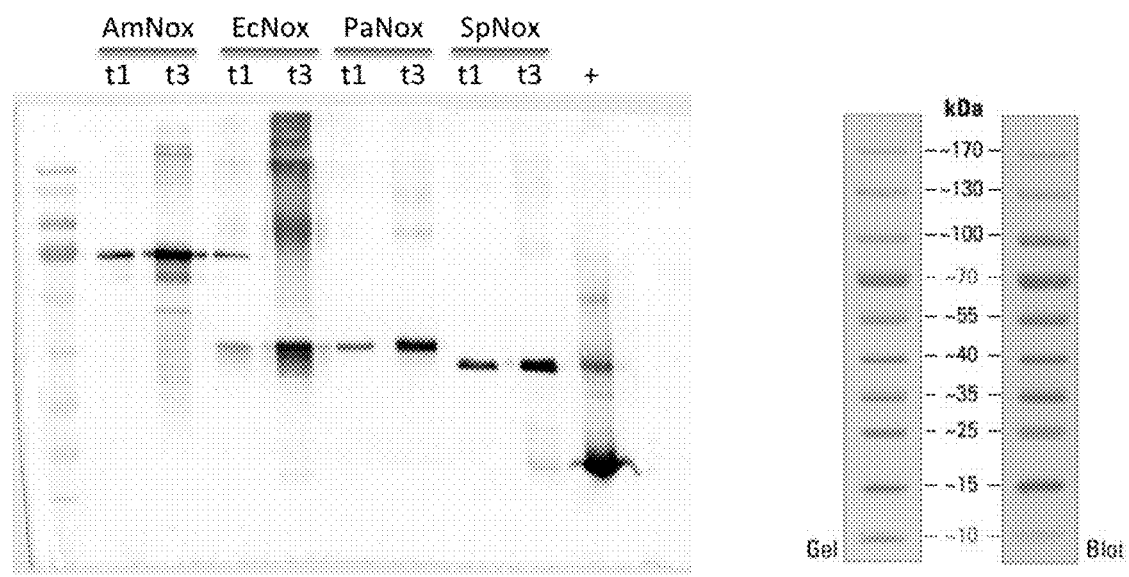
FIG. 9. Western blot immuno-detected by an antibody directed against the polyhistidine tag of the Nox proteins produced. AmNox (*Acaryochloris marina*), EcNox (*Escherichia coli*), Pallox (*Pseudomonas aeruginosa*) and SpNox (*Streptococcus pneumoniae*).

Its activity was assayed (FIG. 7). Based on these data, a purification factor close to 17 and a purification yield of 88% were determined.

A CM Sepharose Fast Flow affinity column (GE Healthcare Life Sciences) was used in order to deplete the excess detergent from the SpNox protein. The sample was diluted in order to bring the concentration of NaCl below the threshold of 15 mM with the aid of a buffer of 50 mM Tris HCl pH7 and 20 µM MNG3. The quantity of resin used depends on the quantity of protein available with a ratio of 0.5 ml of resin for 3 mg of SpNox. Ten column volumes were used for washing the surplus MNG3. 65 to 70% of the protein was recovered.

The sample was checked by FT-IR spectroscopy and analytical ultracentrifugation (FIG. 7).

The sample obtained may be concentrated and/or stored.

Example 3: Protocol for Measuring the NADPH Oxidase Activity of Membranes of BL21 (DE3) pLys Overexpressing SpNox by Colorimetry The oxidase activity is determined by measuring the kinetics of reduction of cytochrome c or Nitro blue tetrazolium chloride, by $O_2.^-$, while monitoring the increase in absorbance at 550 nm (molar extinction coefficient of cytochrome c: $\varepsilon_{550}$=21.1 mM$^{-1}$.cm$^{-1}$).

This assay is carried out on 10 µg of membrane proteins of BL21 (DE3) pLys overexpressing SpNox in a total volume of 1 mL. The spectrophotometer is used for kinetics of 5 mM and at a wavelength of 550 nm.

The buffer for the reaction is the buffer for resuspending the membranes (50 mM Tris pH7).

The blank test is carried out on 10 µg of membrane of BL21 (DE3) pLys overexpressing SpNox and 100 µM cytochrome c. The reaction is then started by adding 100 µM FAD and 200 µM NADPH.

The NADPH oxidase activity is then quantified by calculating the slope of the curve thus obtained (FIG. 4).

Starting from 10 µg of membrane proteins of BL21 (DE3) pLys overexpressing SpNox, the d(OD)/D(t) ratio obtained is between 0.1 and 0.5.

Measurement of the NADPH oxidase activity of the membrane proteins of BL21 (DE3) pLysS not overexpressing SpNox (transformed by the empty vector) on the reduction of cytochrome c makes it possible to confirm that the reduction observed beforehand is indeed due to the presence of SpNox in the membranes.

Example 4: Protocol for Measuring the NADPH Oxidase Activity of SpNox by Colorimetry This assay is carried out on 1 µg SpNox in a total volume of 1 mL using the spectrophotometer for kinetics of 5 min and at a wavelength of 550 nm.

The reaction buffer is the protein storage buffer (50 mM Tris pH7, 300 mM NaCl, 0.03±0.02 mM MNG3).

The blank test is carried out on 1 µg SpNox and 100 µM cytochrome c. The reaction is then started by adding 100 µM FAD and 200 µM NADPH.

The NADPH oxidase activity is then measured using the slope of the curve thus obtained. The result obtained is 24 nanomoles of cytochrome c reduced per minute per microgram of SpNox (or more generally, between 12 and 60 nanomoles of cytochrome c reduced per minute per microgram of SpNox).

This activity can be measured at different concentrations of NaCl (0-1M), KCl and MNG3.

Example 5: Protocol for Measuring the NADPH Oxidase Activity of Membranes of PLB985 Enriched with Eukaryotic Nox by Colorimetry (with the Spectrophotometer)

The following protocol, described for PLB985 cells, can be applied to other cell lines such as HEK 293 (Human Embryonic Kidney) and PMN (Polymorphonuclear leukocytes).

This assay is carried out on 30 to 100 µg of PLB985 membranes in a total volume of 1000 µL.

The reaction buffer is PBS 1×.

Evaluation of the Effect of a Molecule A on the NADPH Oxidase Activity of Eukaryotic Nox 30-100 µg of PLB985 membrane is incubated with increasing concentrations of a molecule A for 5-20 min at 25° C. in a volume of 100 µl. 0.5-4 mM of arachidonic acid, 10-30 µM of FAD and 100-500 nM of trimer (unprenylated trimer, rac 1Q61L) are added to the reaction mixture and incubated with the membranes for 5-20 min at 25° C. according to the protocol described in Mizrahi et al., A prenylated p47phox-p67phox-Rac1 chimera is a Quintessential NADPH oxidase activator: membrane association and functional capacity. J Biol Chem, 2010. 285(33): p. 25485-99.

The reaction is then started by adding 900 µL of PBS containing the substrate of NADPH oxidase, 100-400 µM NADPH (final) and 100 µM final of cytochrome c (or of NBT), which will allow the reaction to be monitored.

After homogenization, the reaction kinetics at 550 nm is monitored for 5 min

Example 6: Protocol for Measuring the NADPH Oxidase Activity of SpNox by Chemiluminescence and Using a Plate Reader This technique is based on the principle of dissipation of energy by emission of light by a compound when it returns from an excited state to a ground state. The chemiluminescence reaction applied is based on an oxidation reaction of luminol (5-amino-2,3-dihydro-1,4-phthalazinedione) dependent on the peroxidase HRP (horseradish peroxidase). The return of excited luminol to its ground state is accompanied by emission of light, which is quantified by a luminometer. The emission of light is directly proportional to the NADPH oxidase activity.

This assay is carried out on 0.1-1 µg of SpNox in a total volume of 100-200 µL. The plate reader is used for kinetics of 5 min-20 min.

The reaction buffer is 50 mM Tris pH7, 300 mM NaCl, 0.03±0.02 mM MNG3.

Evaluation of the Effect of a Molecule A on the NADPH Oxidase Activity of SpNox 0.1-1 µg SpNox is incubated with increasing concentrations of a molecule A for 5-20 min at 25° C. 10-100 µM luminol and 10-50 U/ml HRP are added to the reaction mixture and incubated with the SpNox protein and molecule A at 25° C. away from the light, for 5 min.

The reaction is then started by adding 20-50 µM FAD and 20-150 µM NADPH. For each molecule A tested, 2 checks should be done:
1. By replacing the SpNox protein with 50-500 µM pyrogallol (without adding FAD or NADPH), which will undergo autoxidation in the presence of oxygen, releasing superoxide ions in solution.
2. In the absence of SpNox in the reaction mixture, in order to verify that the chemiluminescence measured can indeed be attributed to SpNox and not to molecule A.

Incubation of SpNox with molecule A and with luminol and HRP may be done simultaneously.

Example 7: Protocol for Measuring the NADPH Oxidase Activity of SpNox by Colorimetry and Using a Plate Reader The oxidase activity is determined by measuring the kinetics of reduction of cytochrome c (or Nitro blue tetrazolium chloride) by $O_2.^-$, by monitoring the increase in absorbance at 550 nm (molar extinction coefficient of cytochrome c: $\varepsilon_{550}$=21.1 $mM^{-1}.cm^-$).

This assay is carried out on 0.1-1 µg SpNox in a total volume of 100-200 µL. The plate reader is used for kinetics of 5-20 min and at a wavelength of 550 nm.

The reaction buffer is the SpNox storage buffer (50 mM Tris pH7, 300 mM NaCl, 0.03 mM±0.02 mM MNG3)

Evaluation of the Effect of a Molecule A on the NADPH Oxidase Activity of SpNox

SpNox is incubated with increasing concentrations of a molecule A for 5-20 min at 25° C. 10-30 µM cytochrome c is added to the reaction mixture and the reaction is then started by adding 20-50 µM FAD and 20-150 µM NADPH.

The NADPH oxidase activity is then quantified by calculating the slope of the curve obtained following reduction of cytochrome c (or of NBT).

For each molecule A tested, 2 checks should be done:
1. By replacing the SpNox protein with 50-500 µM pyrogallol (without adding FAD or NADPH), which will undergo autoxidation in the presence of oxygen, releasing superoxide ions in solution. This assay will make it possible to verify that the effect of molecule A is exerted on SpNox and not on the superoxide radicals that it produces (scavenger effect).
2. In the absence of SpNox in the reaction mixture, in order to verify that the chemiluminescence measured can indeed be attributed to SpNox and not to molecule A.

This activity can be measured at various concentrations of NaCl (0-1M) and of MNG3.

General Protocol for Measuring the Kinetics of Reduction of NBT

The oxidase activity is determined by measuring the kinetics of reduction of NBT by the $O_2.^-$ ions, by monitoring the increase in absorbance at 560 nm (molar extinction coefficient of NBT: $\varepsilon_{560}$=30 000 $mM^{-1}.cm^{-1}$). It is also possible to use a wavelength of 550 nm SpNox is incubated with a reaction mixture containing the molecule to be tested, NBT, FAD and the protein storage buffer for 5 to 20 min at 25° C. The reaction is then started by adding NADPH.

The NADPH oxidase activity is then quantified at the end point by determining the intensity of the coloration compared to a positive control. The positive control is carried out with the SpNox protein alone, without the molecule to be tested.

The compounds present in each well of the plate are, as final concentration:
0.1 µg of SpNox;
2 µM of FAD;
125 µM of NBT;
150 µM NADPH;
Molecule A;
SpNox storage buffer q.s. 200 µL.

All the experiments were carried out in triplicate and each molecule was tested at 5 different concentrations. The concentration range is deliberately wide so as to be able to include the possible IC50 values of each molecule. The concentrations selected are: 0.01-0.1-1-10-100 µM.

Experimental Validation of the High-Throughput Screening Assay:
Two preliminary assays are carried out in the presence of:
1—a bioactive molecule (inhibitory effect) on SpNox, diphenyleneiodonium chloride (DPI);
2—a bio-inactive molecule (without inhibitory effect) on SpNox, DMSO.

The suitability, quality and feasibility of the high-throughput approach are evaluated by establishing a "Z' score" (Zhang et al., J Biomol Screen, 4(2): 67-73, 1999), namely:

$$Z' = 1 - \frac{(3\sigma_{c+} - 3\sigma_{c-})}{|\mu_{c+} - \mu_{c-}|};$$

in which:

$\sigma_{c+}/\sigma_{c-}$: standard deviations of the results obtained for a positive/negative control;

$\mu_{c+}/\mu_{c-}$: mean values of the results obtained for a positive/negative control.

If Z'=1, the suitability, quality and feasibility of the screening assay are ideal.

If 0.5<Z'<1, the suitability, quality and feasibility of the screening assay are excellent.

If 0<Z'<0.5, the suitability, quality and feasibility of the screening assay are marginal.

If Z'<0, the suitability, quality and feasibility of the screening assay cannot be interpreted.

Each preliminary assay must be carried out a minimum of 20 times in order to yield significant values to allow calculation of the "Z' score".

In the present case, the "Z' score" is between 0.7 and 0.8 according to the experiments.

Consequently, an assay in a 96-well plate with SpNox with detection by colorimetry (NBT) constitutes a sufficiently robust and reliable assay to be applied with high throughput.

Screening Against Commercial Molecules Targeting the Eukaryotic NOX:

A total of 8 molecules was selected and tested, 7 inhibitors and 1 activator of the NADPH oxidase activity of the eukaryotic NOX (Table 1).

TABLE 1

| Name | Formula | Property |
|---|---|---|
| Ebselen | | Inhibitor |
| Celastrol | | Inhibitor |
| Thr101 | | Inhibitor |
| VAS2870 | | Inhibitor |

TABLE 1-continued

| Name | Formula | Property |
|---|---|---|
| Catechin | (structure) ·xH₂O | Inhibitor |
| Epicatechin gallate | (structure) | Inhibitor |
| DPI | (structure) Cl⁻ | Inhibitor |
| Arachidonic acid (AA) | $H_3C-(CH_2)_4-CH=CH-(CH_2)_4-COOH$ | Activator |

Figure 10:
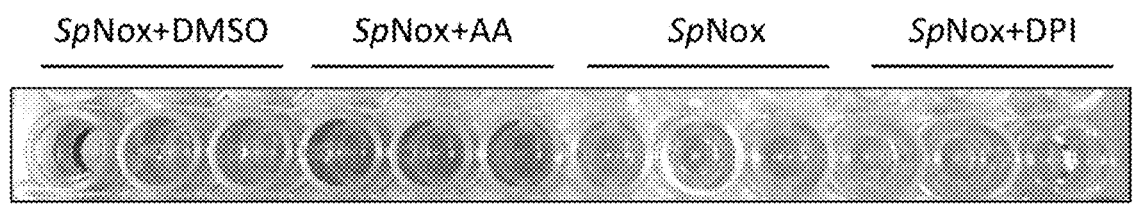
FIG. 10. Analysis of the NADPH oxidase activity of SpNOX by colorimetry, in the presence of DPI and arachidonic acid (AA). The presence of DPI inhibits the reaction as the coloration is less pronounced, whereas arachidonic acid stimulates the production of superoxide and therefore reduction of the tetrazolium salts.
Figure 11:
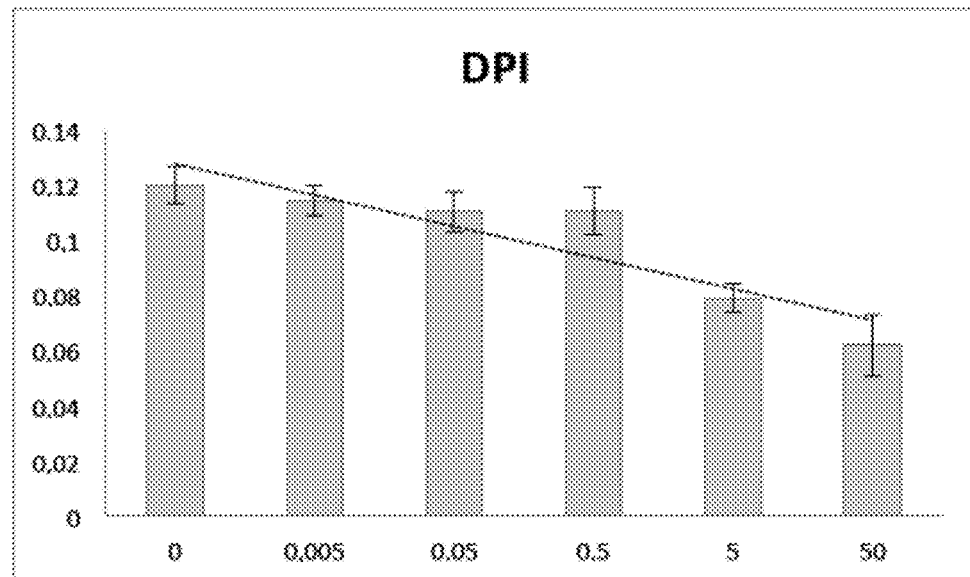
FIG. 11. Measurement of the NADPH oxidase activity of SpNox in the presence of DPI. The y-axis shows the absorbance of the sample at 560 nm. The x-axis shows the concentration (0.005-0.05-0.5-5-50 µM) of DPI in the sample.
Figure 12:
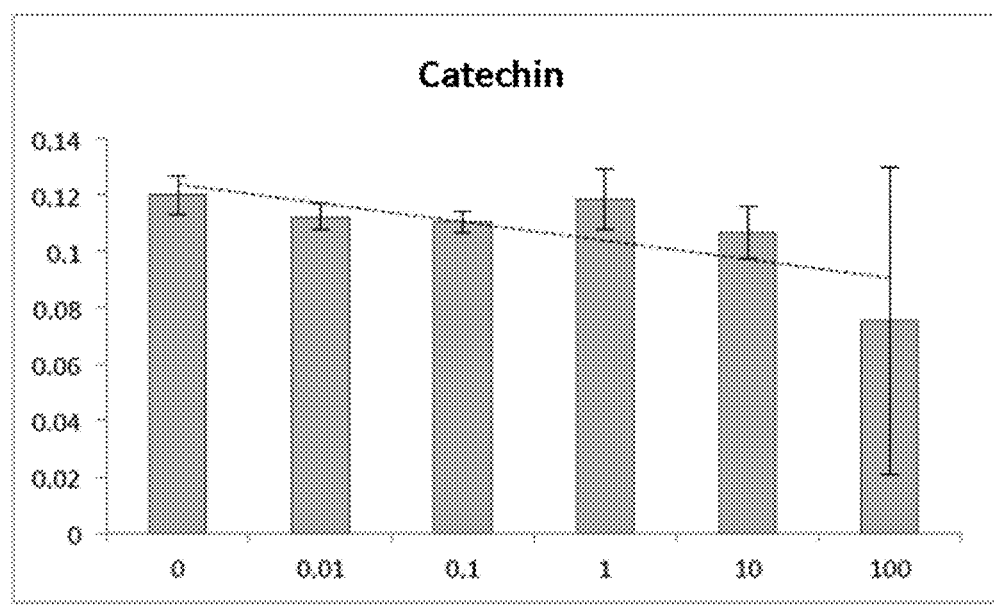
FIG. 12. Measurement of the NADPH oxidase activity of SpNox in the presence of catechin. The y-axis shows the absorbance of the sample at 560 nm. The x-axis shows the concentration (0.01-0.1-1-10-100 µM) of catechin in the sample.
Figure 13:
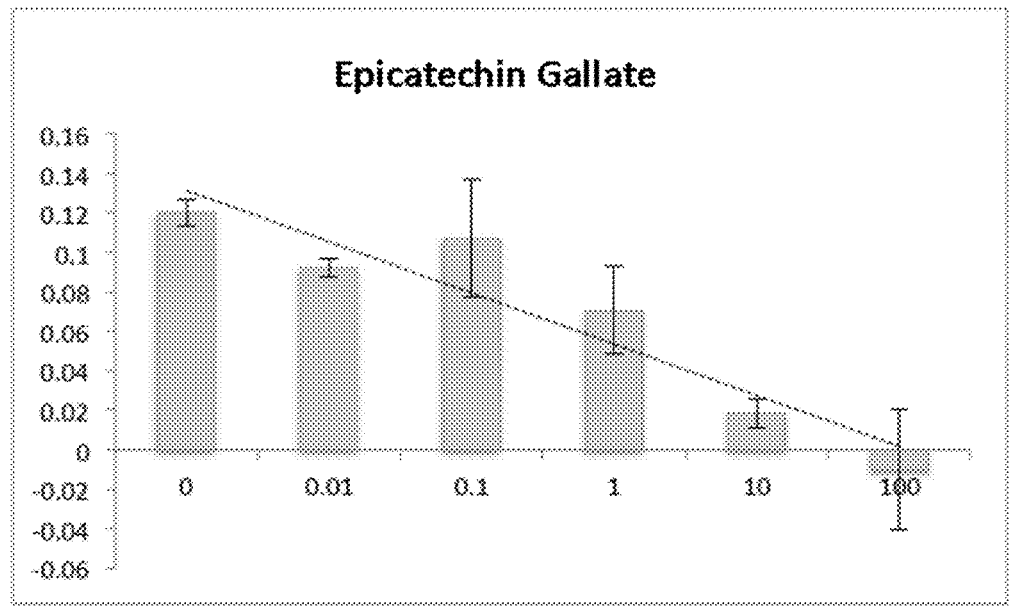
FIG. 13. Measurement of the NADPH oxidase activity of SpNox in the presence of epicatechin gallate. The y-axis shows the absorbance of the sample at 560 nm. The x-axis shows the concentration (0.01-0.1-1-10-100 µM) of epicatechin gallate in the sample.
Figure 14:
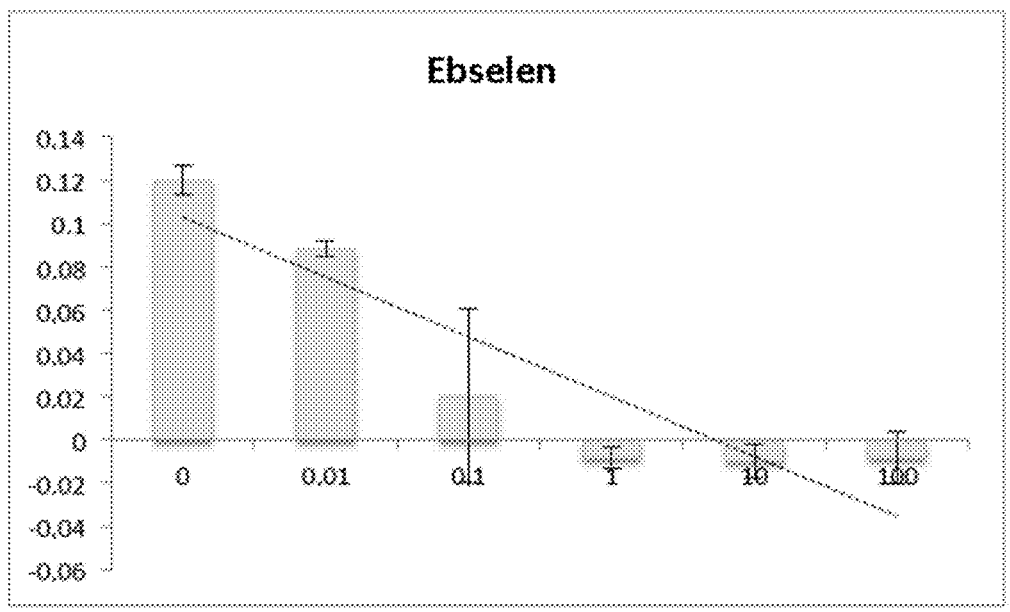
FIG. 14. Measurement of the NADPH oxidase activity of SpNox in the presence of ebselen. The y-axis shows the absorbance of the sample at 560 nm. The x-axis shows the concentration (0.01-0.1-1-10-100 µM) of ebselen in the sample.
Figure 15:
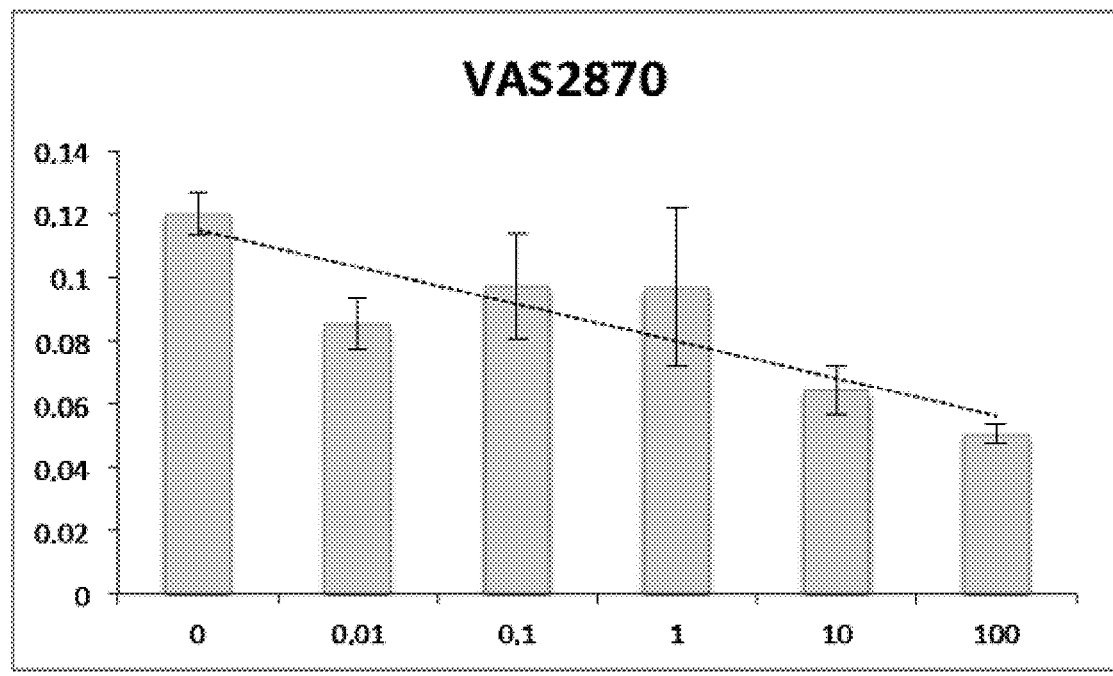
FIG. 15. Measurement of the NADPH oxidase activity of SpNox in the presence of VAS2870. The y-axis shows the absorbance of the sample at 560 nm. The x-axis shows the concentration (0.01-0.1-1-10-100 µM) of VAS2870 in the sample.
Figure 16:
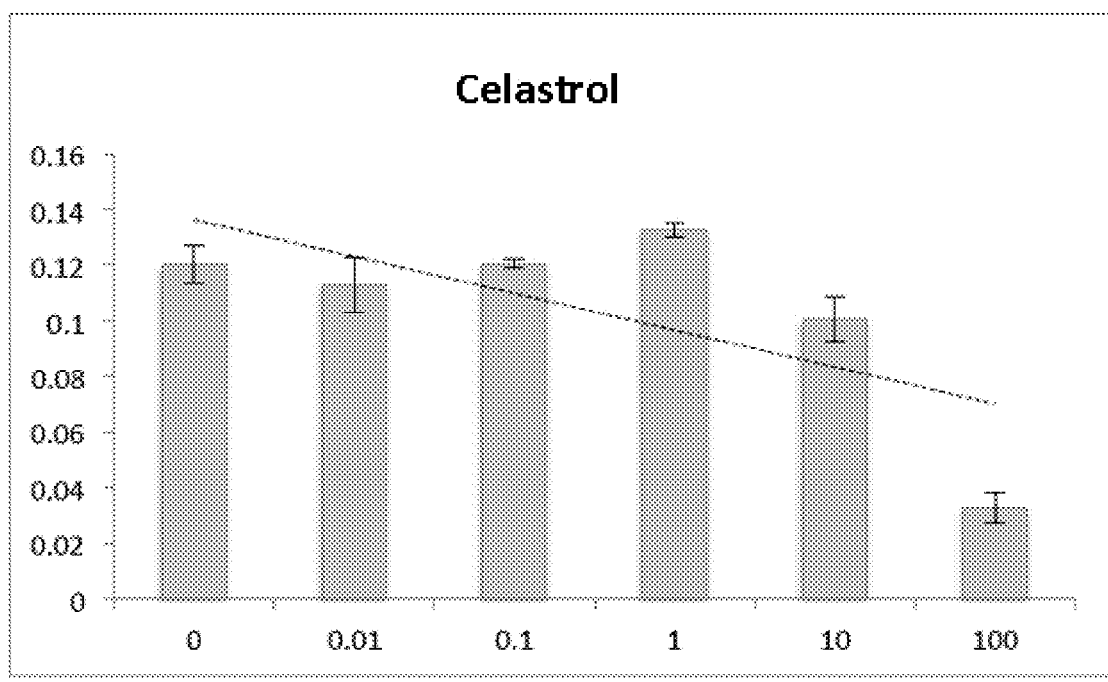
FIG. 16. Measurement of the NADPH oxidase activity of SpNox in the presence of celastrol. The y-axis shows the absorbance of the sample at 560 nm. The x-axis shows the concentration (0.01-0.1-1-10-100 µM) of celastrol in the sample.
Figure 17:
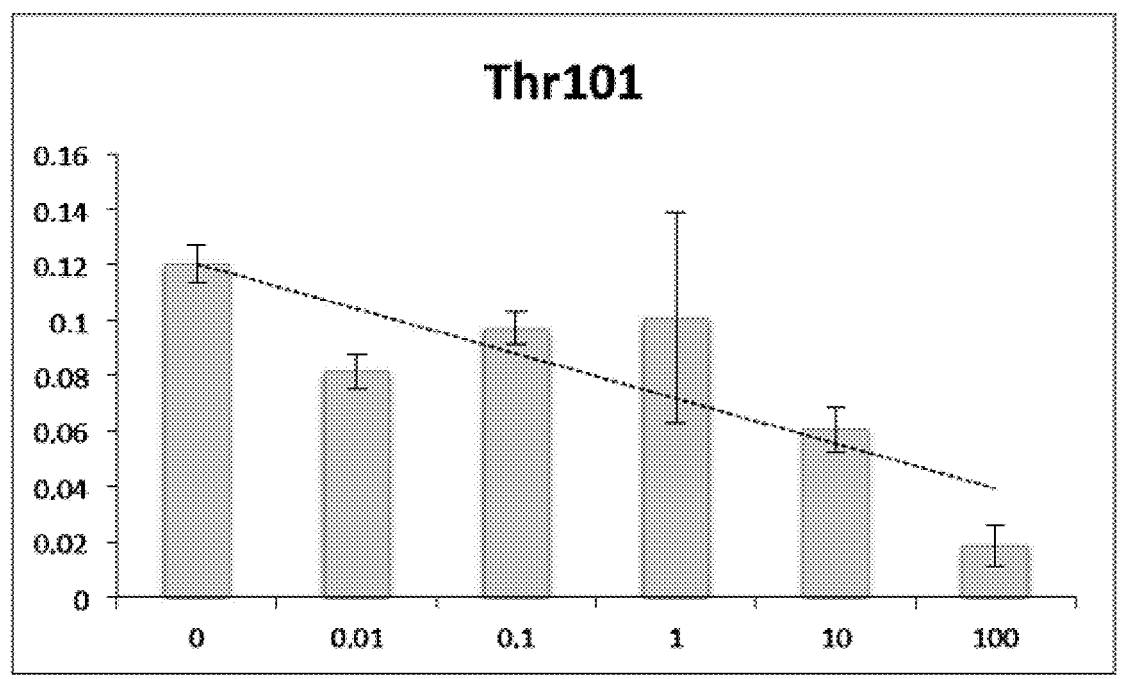
FIG. 17. Measurement of the NADPH oxidase activity of SpNox in the presence of Thr101. The y-axis shows the absorbance of the sample at 560 nm. The x-axis shows the concentration (0.01-0.1-1-10-100 µM) of Thr101 in the sample.

The NADPH oxidase activity of the enzyme may be monitored by colorimetry (or chemiluminescence) (FIG. 10).

Figure 18:
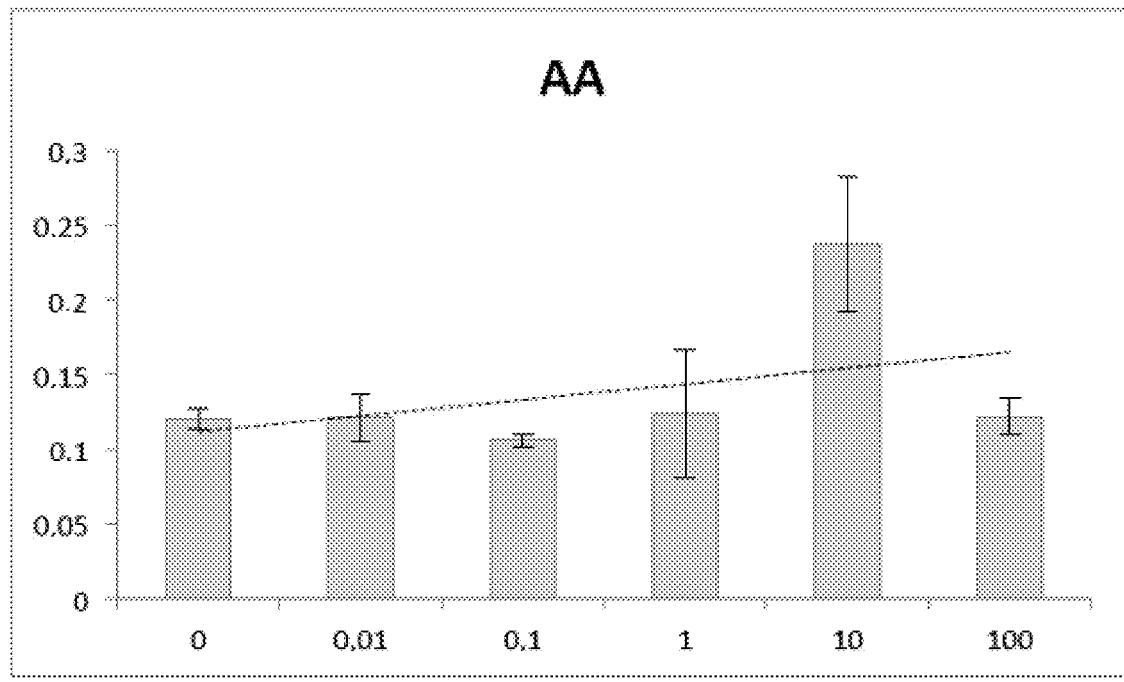
FIG. 18. Measurement of the NADPH oxidase activity of SpNox in the presence of arachidonic acid. The y-axis shows the absorbance of the sample at 560 nm. The x-axis shows the concentration (0.01-0.1-1-10-100 µM) of arachidonic acid in the sample.

The experimental results thus demonstrate that ebselen, celastrol, Thr101, VAS2870, catechin, epicatechin gallate and DPI are inhibitors of SpNox (FIGS. 11 to 17), and that arachidonic acid is an activator of SpNox (FIG. 18).

These results therefore confirm that it is possible to screen molecules modulating the activity of the eukaryotic Nox by using a prokaryotic protein, such as SpNox.

Moreover, these results also indicate that the prokaryotic Nox proteins can also be used for identifying antibacterial molecules, whether or not said molecules have an effect on the eukaryotic Nox proteins.

In fact, the molecules that have an activating effect on the prokaryotic Nox proteins are capable of having a bactericidal or bacteriostatic effect on bacteria, by increasing the production of ROS in the bacteria.

Example 8: Protocol for Measuring the NADPH Oxidase Activity of PLB985 Cells Overexpressing a Eukaryotic Nox, by Chemiluminescence and Using a Plate Reader This technique is based on the principle of dissipation of energy by emission of light by a compound when it returns from an excited state to its initial state. The chemiluminescence reaction applied is based on an oxidation reaction of luminol (5-amino-2,3-dihydro-1,4-phthalazinedione) dependent on horseradish peroxidase (HRP) and the intrinsic peroxidase MPO. The return of excited luminol to its ground state is accompanied by emission of light, which is quantified by a luminometer. The emission of light is directly proportional to the NADPH oxidase activity according to the protocol described in Dahlgren, C. and A. Karlsson, *Respiratory burst in human neutrophils*. J Immunol Methods, 1999. 232(1-2): p. 3-14.

This assay is carried out on $5 \times 10^5$ cells in a total volume of 250 μL. The plate reader is used for kinetics of 15-45 min The reaction buffer is PBS.

Evaluation of the Effect of a Molecule A on the NADPH Oxidase Activity of Eukaryotic Nox $5 \times 10^5$ PLB985 cells are incubated with increasing concentrations of a molecule A for 5-20 min at 25° C. 20 mM glucose, 20 μM luminol and 10 U/ml HRP are added to the reaction mixture and incubated with the cells and molecule A at 25° C., away from the light for 5 min.

The reaction is then started by adding a soluble activator of NADPH oxidase:
PMA 80 ng/ml
FMLP 400 nM
zymosan 0.6 mg/ml After homogenization, the reaction kinetics is monitored for 15-45 min.

Select the programme depending on the activator used in the experiment:
- Zymosan programme: reading for 30 min with one measurement every 15 seconds after stimulation with OPZ (OPsonized Zymosan)
- PMA programme: reading for 30 min with one measurement every 15 seconds after stimulation with PMA
- fMLP programme: reading for 15 min with one measurement every 5 seconds after stimulation with fMLP.

Rates are obtained from 0.00015 to 0.0005 mM of cytochrome c reduced per minute for 5 micrograms of total membrane proteins.

Example 9: Protocol for Measuring the NADPH Oxidase Activity of PLB985 Membrane Enriched with Eukaryotic Nox, by Colorimetry and Using a Plate Reader This assay is carried out on 4-20 µg of PLB985 membrane in a total volume of 200 µL. The plate reader is used for kinetics of 5 min.

The reaction buffer is PBS 1×.

Evaluation of the Effect of a Molecule A on the NADPH Oxidase Activity of Eukaryotic Nox 4-20 µg of PLB985 membrane is incubated with increasing concentrations of a molecule A for 5 to 20 min at 25° C. in a volume of 100 µl. 0.10-1 mM of arachidonic acid, 10-50 µM of FAD and the trimer are added to the reaction mixture and incubated with the membranes for 5-20 min at 25° C. according to the protocol described in Mizrahi, A., et al., A prenylated p47phox-p67phox-Rac1 chimera is a Quintessential NADPH oxidase activator: membrane association and functional capacity. J Biol Chem, 2010. 285(33): p. 25485-99.

The reaction is then started by adding 100 µL of PBS containing the substrate of NADPH oxidase, 100-400 µM NADPH and 100 µM of cytochrome c (or NBT), which will allow monitoring of the reaction.

After homogenization, the reaction kinetics at 550 nm is monitored for 5 min

SEQUENCE LISTING (370 sequences)

SEQ ID NO: 1 - protein, 6 aa, Artificial Sequence
  Consensus sequence
  MISC_FEATURE (1)..(1): Xaa = G or S or A
  MISC_FEATURE (2)..(2): Xaa = Q or D
  MISC_FEATURE (4)..(4): Xaa = A or V or T or L or F
  MISC_FEATURE (5)..(5): Xaa = F or Y or W or L or R
  MISC_FEATURE (6)..(6): Xaa = L or V or I or F or W
XXFXXX

SEQ ID NO: 2 - protein, 6 aa, Artificial Sequence
  Consensus sequence
  MISC_FEATURE (1)..(1): Xaa = P or A or S or E or F
  MISC_FEATURE (3)..(3): Xaa = P or S or A
  MISC_FEATURE (5)..(5): Xaa = T or S
  MISC_FEATURE (6)..(6): Xaa = L or I or M or V
XHXFXX

SEQ ID NO: 3 - protein, 7 aa, Artificial Sequence
  Consensus sequence
  MISC_FEATURE (1)..(1): Xaa = K or R
  MISC_FEATURE (2)..(2): Xaa can be any natural amino acid
  MISC_FEATURE (3)..(3): Xaa can be any natural amino acid
  MISC_FEATURE (5)..(5): Xaa = D or G
  MISC_FEATURE (6)..(6): Xaa can any natural amino acid
  MISC_FEATURE (7)..(7): Xaa = T or S
XXXGXXX

SEQ ID NO: 4 - protein, 6 aa, Artificial Sequence
  Consensus sequence
  MISC_FEATURE (2)..(2): Xaa = I or S or V or L
  MISC_FEATURE (4)..(4): Xaa = V or I or A or F
  MISC_FEATURE (5)..(5): Xaa = T or A or S
  MISC_FEATURE (6)..(6): Xaa = P or Y or T or A
GXGXXX

SEQ ID NO: 5 - protein, 6 aa, Artificial Sequence
  Consensus sequence
  MISC_FEATURE (2)..(2): Xaa = Q or D
  MISC_FEATURE (5)..(5): Xaa = F or Y
  MISC_FEATURE (6)..(6): Xaa = L or V
GXFAXX

SEQ ID NO: 6 - protein, 5 aa, Artificial Sequence
  Consensus sequence
  MISC_FEATURE (2)..(2): Xaa = P or S or A
  MISC_FEATURE (4)..(4): Xaa = T or S
  MISC_FEATURE (5)..(5): Xaa = L or I or M or V
HXFXX

SEQ ID NO: 7 - protein, 7 aa, Artificial Sequence
  Consensus sequence
  MISC_FEATURE (2)..(2): Xaa = Q or D
  MISC_FEATURE (4)..(4): Xaa = A or V or T or L or F
  MISC_FEATURE (5)..(5): Xaa = F or Y or W or L or R
  MISC_FEATURE (6)..(6): Xaa = L or V or I or F or W
  MISC_FEATURE (7)..(7): Xaa = K or T or R or S or A or E or N
GXFXXXX

SEQ ID NO: 8 - protein, 6 aa, Streptococcus pneumoniae
GQFAFL

SEQ ID NO: 9 - protein, 6 aa, Salmonella enterica
GQFAFV

SEQ ID NO: 10 - protein, 6 aa, Vibrio cholerae
GQFAYL

SEQ ID NO: 11 - protein, 6 aa, Streptococcus pneumoniae
PHPFSI

SEQ ID NO: 12 - protein, 6 aa, pseudomonas aeruginosa
AHPFTI

SEQ ID NO: 13 - protein, 6 aa, Vibrio cholerae
PHPFTI

SEQ ID NO: 14 - protein, 6 aa, Escherichia coli
SHPFTI

SEQ ID NO: 15 - protein, 7 aa, Streptococcus pneumoniae
KTSGDHT

SEQ ID NO: 16 - protein, 7 aa, Pseudomonas aeruginosa
KALGDYT

SEQ ID NO: 17 - protein, 7 aa, Escherichia coli
KNLGDYT

SEQ ID NO: 18 - protein, 7 aa, Vibrio cholerae
KELGDFT

SEQ ID NO: 19 - protein, 7 aa, Salmonella enterica
KSLGDFT

SEQ ID NO: 20 - protein, 7 aa, Bordetella pertussis
KGLGDYT

SEQ ID NO: 21 - protein, 6 aa, Streptoccus pneumoniae
GIGITP

SEQ ID NO: 22 - protein, 6 aa, Pseudomonas aeruginosa
GIGVTP

SEQ ID NO: 23 - protein, 6 aa, Vibrio cholerae
GVGIAP

SEQ ID NO: 24 - protein, 400 aa, Streptococcus pneumoniae ATCC BAA-255
MEFSMKSVKGLLFIIASFILTLLTWMNTSPQFMIPGLALTSLSLTFILATRLPLLESWFHSLEKVYTVHKFTAFLSIILLIFHNFSMGGLWGSRLAAQFGNLAIYIFASIILVAYLGKYIQYEAWRWIHRLVYLAYILGLFHIYMIMGNRLLTFNLLSFLVGSYALLGLLAGFYIIFLYQKISFPYLGKITHLKRLNHDTREIQIHLSRPFNYQSGQFAFLKIFQEGFESAPHPFSISGGHGQTLYFTVKTSGDHTKNIYDNLQAGSKVTLDRAYGHMIIEEGRENQVWIAGGIGITPFISYIREHPILDKQVHFYYSFRGDENAVYLDLLRNYAQKNPNFELHLIDSTKDGYLNFEQKEVPEHATVYMCGPISMMKALAKQIKKQNPKTELIYEGFKFK

SEQ ID NO: 25 - protein, 434 aa, Pseudomonas aeruginosa ATCC 15692
MKLLWGVLAAALAAWGLTLAVDPPASLDIWVVRKQAILLTGVASFALMSLIMLLAVRPVWLEKPLDGLDRMYRLHKWAGILAIVLGLLHYLLELAGPWLAGIVGKPVKGPRVETFLDVFRGSAKELGEWSAWILGGMLLVTLWQRFPYHLWRYVHKALALVYLVLAFHSVVLAPASYWSQPAGWLVAACALLGSACALLSLSGRIGRTRRHAGVVTAVERHGESLLEVTCRLQGDWSHRAGQFAFLTCDRLEGAHPFTIASADRGCGEVRFSIKALGDYTRRLQDNLEVGARVEVEGPYGCFDFRRGLAGRQVWVAAGIGVTPFIAWLESLQAAPESAPSVELHYCVRNSQEALFAGRLRELCEHLPSVTLHIRYSDEQGKPQAAQLGVLKSAEGRWPSVWFCGPQGLADSLRRDLRRQGMPLRLFHQEAFRMR

SEQ ID NO: 26 - protein, 441 aa, Escherichia coli MS 21
MKKANLTGTLVCFVACLIFLSSGDIFREKPIALIWFLRQNILFFTGTLAWCLMTLTMCLSLRSSWLNKVLGGLDKAWRLHKWAGICAIAFAFAHWLDEKLPQLFVAFGWLTHPGKIVDINLTPVQENWLHAGLLAGECAMFIIIAMVCVSLSKRVPYHLFHLVHRLFPVFYLAIAFHVFTALFKSYWWETPAAYLLILITIPGVFAAFISLLKLNGSKNKHQATIKNIVNHPGQITEVTLELEHAIDYSPGQFAFLTFAHSKESHPFTIASYTKEKNTLRFAIKNLGDYTSTLASSIKIGQSAFVEGPWGKFDFTLPCSHQVWIAGGIGITPFIAQLEYRKHHGASSVPVDIWYCVSRSEDAWYVDKLTSLCAQARVTLHLLDAHKGERLQAHYLTDKIANKGDTHFWFCGPQSFAKALSKGLYENGIASQNFHYDRFCMR

SEQ ID NO: 27 - protein, 404 aa, Vibrio cholerae CIRS101
MQFSGILALMLMSLAMLLALRLPLIEQWTQGIDKGYRIHKWLGISALLLGIFHWLAYHLPKWLISLELLTKPARLNGSGPNSNLSGLALWLKEAKPLAMEIGEWGFYALIVLLVVSLWSAIKYKPFRLTHRLMAVVYLLIALHSVILLKKAYWGEPIYWLTMLFIVVGSWAACYSLLGLVGRQSRYPAHVKAFHYCPNSQTLDLTIQLDKPWLGHKAGQFAYLKFAGEEPHPFTIACAHQGSQLRFLIKELGDFTTGLHQRLQNGKSLEVEGPYGKFDFSTQQPQIWIGGGVGIAPFMAGLDWLMRERAHPPVHLFFCCHQIDPDLCAELRHKAQLAGVSLTIIDSSVDPHLSADDIARRCGDLSRFEIYFCGPIAFSNSLKKALKPYQVDLSRQFHEEQFVMR

SEQ ID NO: 28 - protein, 438 aa, Salmonella enterica CFSAN002050
MMRMIFPFVVLVLGLWAWNLFAGPGAGSPWAVYDQSLLLSGLLSIALMSLTMMLALRPAWLERPLGGLDQIYRTHKWAGILAVVFAAAHWLIEMGDDVIESIFGKAGRLHDQDYSGFIDTMRDAAEEVGEFAVYLLFAMLLITLWRKFPYKYWRYLHRGMPVLYLLLAFHAAWLTPLQWWQQPIGLLMAILLFGGSIASGLSLTGRVGRRRQVRGMVTAIKTPDRDVTEVTCHMGPAWPGHRAGQFAFVTFDRIEGAHPFTIASADRENGTVTFLIKSLGDFTRNLSQKISVGQTVNIEGPYGCFNFDRRNRKSHQIWIAGGIGITPFLAWLEALSSATDATVPEADLHYCTRNAGQDPMVDRLRALCDGFPGIHLEIHDSSKGQRLSAETLSTNGRSAAGAEVWFCGPAGLGEAIRNGLRAAPFRLTRFHKEAFQFR

SEQ ID NO: 29 - protein, 446 aa, Bordetella pertussis CS
MRRLRTIFILLVAALSVLWLSQNPPGAWGEGFWVMRKPLIYYTGILALGMMSLGVILAARPARFEGALGGLDKFYRLHKWLGLGGVALALTHWLLKIVPPWMAAQGWTVRPPRVPAPAGQAALYDPFQAWHGVAKSLGEWGLYALLLLAALALYKRFPYRHFFRTHRLMPALYLVFVFHAVVLMAPAYWRGPIGPVMAVVMAAGGAGALLSLLGLIGRPRQAAGRIARLERFADNAVMQVDVQLETRWPGHKAGQFAFVAFDRAEGAHPFTISSAWRDDGLLRFSIKGLGDYTRSLPARLRVGDGVTVEGPYGRFDFRANGRPQILVAGGIGITPFLARLQDMAAARSDGAPAHEVDLVYSTNAPDPDFIGELRALAERARVGLHVLVTQRDGKLSAERLVDMLPRAAQSEVWFCGPAGFGQALREGLAARGMPPACFHQELFEMR

SEQ ID NO: 30 - protein, 423 aa, Serratia sp. ATCC 39006
MYYLLGIIVICAMAWLTSLPAQNDVVDFIYWRNQIIQLSGLLSTVLLSTLLIFATRPSWIEQRLGGLDKLYLLHKKMGIAACIMITIHWLLSKAPRYLSELGFIRLGPHRNHGAIPWRGFMVDIGEIAFYGIVIIVIISLIKALPYNQFKITHKIAAIVAALALIHGAYLVTPALRWTSFGILTWLTSATGFCAALFCLSGQIGKKHRFSGHIIAGRSLNDDVIEIDISAAQGFVEKYQPGQFALVTLDEKEGSHPFTVMKYDRKNSILTFAIKKLGDYTGRLHASIKNGASVSVEGPYGRFILPSNSNTTTYWIAGGIGITPFIAWLEALVERNEKRPHTTLIYCVNNHQDLIFEEQLKRLTALCGITLKILVQKQDGLLVPSTLNNYQNSDYWFCGPIGMRKMLLANLPKNRIHFENFTFR

SEQ ID NO: 31 - protein, 447 aa, Streptococcus agalactiae 18RS21
LLYFSEILKFCISILWYLSLLKNKGVVVMRAWKGIVLILSSIVVTLVAWQNAGLSEFVVPGLALTSLSLTFLLSTKFRILESYFQGIENMYFYHKVMAVFSMILLLLHKIGLGQGGHGSEFAKTIGSAGLYLFLSIVFVAYFGNFLKYEIWRFIHRFVYLAYILGLVHTFMILGDRILGNTLLSLIVLGYAVIGVISGFYIIFLYSRMRFRRVGYVQKVTHLNHDTTEIEIAMKRPYRYDYGQFTFFKIYQAGFESAAHPFSISGGHDRVIFLTVKASGDYTKSIYKQLKVGTKIALDRAYGHMLFDKDKKEQVWIAGGIGITPFISFIRENSILTKRVDFFYTFSNQDNLIYQDMLESYAKANPNFKLHLNNSSLKGRLDFSQSVFEGQPTIFMCGPTSMTSTYAKVFRQKDAKSRLVYEGFSFRDSWLSIFLLKTFDKVYSNLIK

SEQ ID NO: 32 - protein, 392 aa, Acidovorax sp. KKS102
MAAWALMSLIMVLAVRPAWLEKPLGGLDKSYRLHKWAGIGAIVLALLHYGLQLSRSLLADWVGRPVRTPRADWWFNTFRHLAEEMGEWAVWFLAAMLVITLWQRFPYHVWRYLHKLLAVVYLVLAFHAVVLTPPAWWQQPAGVLVGLCTLVGVLCAVRSLAGAIGRSRRHAARVVSVAPRGARVLEVTCQVSPASAWRHTAGQFAFVTFGKAEGAHPFTLLNADQGDGTLRFAIKALGDHTAQLPLQVQPGQRVDIEGPYGCFDFRSDSAPEQVWVAAGIGATPFMAWLESLQTTPALAPRVHLHYCVRHADEAVFAERMGALCARLPSVTLEIHYSNDTGPVTPAALLAGTSPAASVWFCGPQGFAEAVRQGMEQLGRSPARFHQELFQMR

SEQ ID NO: 33 - protein, 421 aa, Rhodopseudomonas palustris BisB5
MAAYGAGFRVWSVPLLTIAVPLGFVVWAFPHGLAPLRAAGIVTGWLGCGLLLVSLLLMLREPRLANWLGGLERMYRWHHVTGVAAYVFLLLHPLALAAGNWQTSRVLAWHTLSPVEESWPVWSGWLGLLLLMIGLAATFTPSIRYGAWRWLHALLGIGVVIGLVHLILLGIDEPVLPILAIAAAILGWRLLRGDLGLGARPYIVATARKLTARSVEIVLRPLADPVTLSTGQFVLVAFRNGPVYRGCGEFHPFTISSIDGDGALHLAVKALGDCTSRMLSIEPGVAARVIGGFGSFLSEVSGAPQLWIAGGIGVTPFVALLNDGRLRHPARLLYLYRREDDATYLREMRQIAATDPNLTLQTIVTGDELPDIEGLLPDARELSGVECYLCGPPGLVGALKQVLSARGVAAQHIHFENFEFR

SEQ ID NO: 34 - protein, 464 aa, Rhodopseudomonas palustris BisB18
MAGFSRKTCALLISPIGSTRMQFTRLTTTFAFAVVGLAGLWLLSLAPDALSQGFWATRTTLVYGSGVLALGLMSVGVILAARPLWFETALGGLDKFYRLHKWLGLAALGFAIAHFVLRKGPSWLSELGLFAVPPKPPHAKEVATGFDLFRELKHPAAEIGEWAFYLLLALVALALWKRFPYKYFFKTHRLMPAIYLVLVFHAVILIDRSYWLRPLGPVLALLLMAGTLAALIALFRKIGLSRRASGSIAKLALYDGNQVLDVEIRLETTWPGHQAGQFAFVNFDDVEDAHPFTISSAWHDDGLLLFSIKGLGDYTRTLAGNLHLGQGVVVEGPYGRFNFEGASHRQIWIGGGVGVTPFIARLRQLARVGRTDPVDLFYATNAPDPAFLAPIRQLAEQTGVAFHLVDGSQAGRLTLESLTVMVPDWKQADVWFCGPRGFGVAMRSAMLAQGLPTSRFHQELFEMR

SEQ ID NO: 35 - protein, 469 aa, Thauera aminoaromatica S2
MAHNFPHGIRCLMAAAFRSKGAIMKNIKLALLLVLATLSLLWWWADPLLVQGDTYFALRTLAVNYTGVLAMGAMSIAMILALRPAALEPLLGGMDKAYRLHKWLGIAGLSVGVVHWLWAKGTKWAVGWGWLQKPARGPRPEQTVELFRFFQEQRGLAETIGEWAFYLFAVLAAIALIKRFPYRRFVQTHRVMAAVYLALVVHGVVLLPFAYWTQPLGMVMGMLMAAGSWAALRSLAGRIGRGRRAHGRIERVVRHPANQVLEVGLRLDTPWPGHQAGQFAFVTFDEREGPHPFTISSAWGGDGRMDFMIKPLGDYTRSLPATLKLGDPVRVEGPYGRFDFGGAQARQIWVAGGIGITPFVARMQARAQEDRPGGRAAAIDLFYSTSAPDEGFIARLRELAARARVQLHVLVSPRDGRLDADGICRSVPDWKQAGVWFCGPAGFGAMLRDTLAARGLPAERFHQELFEMR

SEQ ID NO: 36 - protein, 419 aa, Psychrobacter sp. G
MALKSWQVIGSVVLITSITVLMQISSETWITSATVSLIMGASALACMASSCILASRWHGIERLFGGLDRVYEAHKWIAIWALIFAVYHFVFKAKLDAWDLAPILELSKYWTRLMRQLSLVALGLIILLALNRKIPYGNWRWLHKFSGPLFLIVILHWLSFESPITLTSPAGIWLALLCSVGVIAALYKMILYPFIAKAGEYKLVAISQGKAAVHLEFEPVRKGFQFKAGQFAFISLKEPGLHEPHPFTIANAPSDTGHIHFVIRALGDYTKKLNEQAKVGMLADIYAPHGNFKRISNAEREIWIGAGVGISPFISWQEDKTIGHFERATLIYCFDPARVFPSVERMQEMTEQSGVDFVANPSGSNAMAETIRQVASEVNPKQIQISFCGPKGLLGKVQELMKENGIPAKNIHYEFFDFR

SEQ ID NO: 37 - protein, 433 aa, Aeromonas salmonicida A449
MASLPYGKALTEESPSVTKNKFANEMIIRNGARCSWQYRLRDLLILLVTWIGWLLLALRLPRLEVWCGGLDRMLRLHRHSAMAATLALTSHWLLVEAPKWAVTAGWLTRPARRGAGGGAGAGAGNGFSLHALGNTLGEWSFYLLIALVVVSLLSLVSYGRFRVIHRLAPLIYLAGWVHGLCLLPQVGLLTPVGLGISLLGGAGAVAAVYSLLGLTGQRDRHQGRIVALRTLADSTREFTLQLATPLSHYRPGQFAFFEFDAKEGPHPFTLVRVSPDKRQLVIAVRALGDHTRQLVEAARVDGPVTVTGPYGAFVCPARQGQSLWLGAGIGITPFVAWLEGLVVRGERGEGITLIQCAPDLAGAVYHQRLAELCQRTGVRYRLHLDKEAGRLDLAGLAQGKPGDVWFCGPERMADALTRLLPGGRLHRELFRFR

SEQ ID NO: 38 - protein, 421 aa, Rhodopseudomonas palustris HaA2
MASPAAALQRWSIPLLTLSVPLGFVAWAFPTGLAPLRAAGIVTGWLGCGLLLVSLLLMLREPRLAYWLGGLERMYRWHHVTGVVAYVALLLHPLALAAGNLAASPRLAWQTLSPATESWQVWSGWLGLLLLMVGLATTFTPSIRYGLWRWLHALLGIGVVIGLVHLILLGIDEPVLPILAAAAGILGWRLLRGDLGLAARPYIVAAVRKLTPQSVEIELRPLADPVTVTAGQFVLVAFGNGPLYRGCGEFHPFTISAIDRDGALRLAVKALGDCTRRMLSIEPGVAARVIGGFGGLLGDAGASPQLWIAGGIGVTPFVALLNEGRLRQPVRLLYLYRREADATYLPELRAIAASDPQLKLQAVATGDDLPDLDRLLPATSELSGVECYLCGPAGLVAALQRALGARGVAAQHIHFENFEFR

SEQ ID NO: 39 - protein, 419 aa, Psychrobacter sp. PRwf-1
MAVKSWQVISSIVLITSITVLMQIPSETWITSATVSLIMGASALACMASSCILASRWHGVERIFGGLDRVYEAHKWIAIWALVFAVYHFLFKAKLDSWELAPILELSKYWTRMVRQLSLVALGLIILLALNRKIPYGNWRWLHKFSGPLFLIVILHWLSFESPITLTSPAGIWLALLCSVGVIAALYKMVFYPFIAKAGEYKLVAISHGKAAVHLEFEPVDKRFPFKAGQFAFISLKEAGLREPHPFTIANAPSDNGRIHFVIRALGDYTKKLNEQAKVGMLADIYAPHGNFKRISNAEREIWIGAGVGISPFISWQEDKTIGHFERATLIYCFDPARVFPSVERMQEMTEQSGVDFVANPSGSNAMAETIRQVASEVNPKQIQISFCGPKGLLGKVQELMKENGIPAKNIHYEFFDFR

SEQ ID NO: 40 - protein, 447 aa, Vibrio vulnificus YJ016
MDLVMDRVKQSIGIAVVIVTLLWLQAEPSLFFSQNVFQWRSAFVQYSGILALMMFSAAMVLALRLPTIERWTQGIDKGYRIHKWLGIAGLSLGVFHWFTYHLPKWLISLELLEKPVRFDGSGPHGQLSEWGVWLKQAKPVAMAMGEWGFYLLIALVVVSLWSAVKYKSFRLSHQLMPVAYLFIAAHAFILLKKAYLGTPIYWVTLLFLSVGSLAAIYSLFGLIGKKVRYAAQVTRIHYCLNSQTLDLTVAVENRWKGHKAGQFVYLSFAGEEPHPFTIASAAQGNQLRFLIKELGDFTTGLRDRIRVGERLEIEGPYGQFDFSANKAQIWIGGGVGIAPFMAGLDALAAIEHSRRVHLFFCCQKVDPQMCEELKRKAHTAHASLTIIDASVDPLLTAEDIAKQCGDLRNYEFYFCGPVAFSHALKQALKPYRVDIHQRFHEEWFVMR

SEQ ID NO: 41 - protein, 443 aa, Vibrio vulnificus CMCP6
MDRVKQSIGIAVVIVTLLWLQAEPALFSSQNVFQWRSAFVQYSGILALMMFSAAMVLALRLPTIERWTQGIDKGYRIHKWLGIAGLSLGVFHWFTYHLPKWLISLELLEKPLRFDGSGPHGQLSEWGVWLKQAKPVAMAMGEWGFYLLIALVVVSLWSAVKYKSFRLSHQLMPVAYLFIAAHAFILLKKAYLGTPIYWVTLLFLSVGSLAALYSLFGLIGKKVRYAAQVTRIHYCPNSQTLDLTVAVENRWKGHKAGQFVYLRFAGEEPHPFTIASAAQGNQLRFLIKELGDFTIGLRDRIRVGERLEIEGPYGQFDFSANKAQIWIGGGVGIAPFMAGLDALAAIEHSRRVHLFFCCQKVDPQMCEELKRKAHTAHASLTIIDASVDPLLTAEDIAKQCGDLRDYDFYFCGPVAFSHALKQALKLYRVDIHQRFHEEWFVMR

SEQ ID NO: 42 - protein, 443 aa, Vibrio vulnificus MO6-24
MDRVKQSIGIAVVIVTLLWLQAEPSLFSSQNVFQWRSALVQYSGILALMMFSVAMVLALRLPTIERWTQGIDKGYRIHKWLGIAGLSLGVFHWFTYHLPKWLISLDLLEKPVRFDGSGPHGQLSEWGVWLKQAKPVAMAMGEWGFYLLIVLVVVSLWSAVKYKSFRLSHQLMPVAYLFIAAHAFILLKKAYLGMPIYWVTLLFLSVGSLAAIYSLFGLIGKKVRYAAQVTRIHYCPNSQTLDLIVAVENRWKGHKAGQFVYLRFAGEEPHPFTIASARQGNQLRFLIKELGDFTTGLRDRIRVGERIEIEGPYGQFDFSANKAQIWIGGGVGIAPFMAGLDALAAIEHSRRVHLFFCCQKVDPQMCEELKRKAHTAHASLTIIDASVDPLLTAEDIAKQCGDLREYDFYFCGPVAFSHALKQALKPYRVDIHQRFHEEWFVMR

SEQ ID NO: 43 - protein, 400 aa, Streptococcus sp. M334
MEFFMKSLKGLLFIIASFVLTILTWMSTSPQFMIPGLALTSLSLTFILATRLPLLESWFHGLEKVYTVHKFTAFLSIILLIFHNFSMGGLWGSRLAAQFGNLAIYIFVSIILVAYLGKYIQYEAWRWIHRLVYLAYIFGLFHVYMMMGNRLLTFNLLSFLVGSYALLGLVAGFYIIFLYQKIGFPYLGKITNLKRLNHDTREIQIHLSRPFNYQAGQFAFLKIFQEGFESAPHPFSISGGHGQTLYFTVKNSGDHTKNIYDNLQVGSKVSVDRAYGHMIINQGRKNQIWIAGGIGITPFISYIREHPILDKQVHFYYSFRGEENAVYLDLLRDYAQKNPNFELHLVDSRKDGYLNFEQKEVPEHASFYMCGPLSMMKSLSKQIKKQNPKAELIYEGFNFK

SEQ ID NO: 44 - protein, 400 aa, Streptococcus pneumoniae strain ST556
MEFSMKSIKGLLFIIASFILTLLTWMNTSPQFMIPGLALTSLSLTFILATRLPLLESWFHGLEKVYTVHKFTAFLSIILLIFHNFSMGGLWGSRLAAQFGNLAIYIFASIILVAYLGKYIQYEAWRWIHRLVYLAYILGLFHIYMIMGNRLLTFNLLSFLVGSYALLGLLAGFYIIFLYQKISFPYLGKITHLKRLNHDTREIQIHLSRPFNYQSGQFAFLKIFQEGFESAPHPFSISGGHGQTLYFTVKNSGDHTKNIYDNLQAGSKVTLDRAYGHMIIEEGRENQVWIAGGIGITPFISYIREHPILDKQVHFYYSFRGDENAVYLDLLRNYAQKNPNFELHLIDSTKDGYLNFEQKEVPEHATVYMCGPISMMKALAKQIKKQNPKTELIYEGFKFK

SEQ ID NO: 45 - protein, 400 aa, Streptococcus pneumoniae serotype A19 TCH8431
MEFSMKSVKGLLFIIASFILTLLTWMNTSPQFMIPGLALTSLSLTFILATRLPLLESWFHGLEKVYTVHKFTAFLSIILLIFHNFSMGGLWGSRLAAQFGNLAIYIFASIILVAYLGKYIQYEAWRWIHRLVYLAYILGLFHIYMIMGNRLLTFNLLSFLVGSYALLGLLAGFYIIFLYQKISFPYLGKITHLKRLNHDTREIQIHLCRPFNYQSGQFAFLKIFQEGFESAPHPFSISGGHGQTLYFTVKNSGDHTNNIYDNLQAGSKVTLDRAYGHMIIEEGRENQVWIAGGIGITPFISYIREHPILDKQVHFYYSFRGDENAVYLDLLRNYAQKNPNFELHLIDSTKDGYLNFEQKEVPEHATVYMCGPISMMKALAKQIKKQNPKTELIYEGFKFK

SEQ ID NO: 46 - protein, 371 aa, Streptococcus pneumoniae PNI0009
MEFSMKSVKGLLFIIASFILTLLTWMNTSPQFMIPGLALTSLSLTFILATRLPLLESWFHGLEKVYTVHKFTAFLSIILLIFHNFSMGGLWGSRLAAQFGNLAIYIFASIILVAYLGKYIQYEAWRWIHRLVYLAYILGLFHIYMIMGNRLLTFNLLSFLVGSYALLGLLAGFYIIFLYQKISFPYLGKITHLKRLNHDTREIQIHLSRPFNYQSGQFAFLKIFQEGFESAPHPFSISGGHGQTLYFTVKNSGDHTKNIYDNLQAGSKVTLDRAYGHMIIEEGRENQVWIAGGIGITPFISYIREHPILDKQVHFYYSFRGDENAVYLDLLRNYAQKNPNFELHLIDSTKDGYLNFEQKEVPEHATVYMCG

SEQ ID NO: 47 - protein, 398 aa, Streptococcus pneumoniae PCS81218
MEFSMKSVKGLLFIIASFILTLLTWMNTSPQFMIPGLALTSLSLTFILATRLPLLESWFHGLEKVYTVHKFTAFLSIILLIFHNFSMGGLWGSRLAAQFGNLAIYIFASIILVAYLGKYIQYEAWRWIHRLVYLAYILGLFHIYMIMGNRLLTFNLLSFLVGSYALLGLLAGFYIIFLYQKISFPYLGKITHLKRLNHDTREIQIHLSRPFNYQSGQFAFLKIFQEGFESAPHPFSISGGHGQTLYFTVKNSGDHTKNIYDNLQAGSKVTLDRAYGHMIIEEGRENQVWIAGGIGITPFISYIREHPILDKQVHFYYSFRGDENAVYLDLLRNYAQKNPNFELHLIDSTKDGYLNFEQKEVPEHATVYMCGPISMMKALAKQIKKQNPKTELIYEGFK

SEQ ID NO: 48 - protein, 400 aa, Streptococcus pneumoniae PCS125219
MEFSMKSVKGLLFIIASFILTLLTWMNTSPQFMIPGLALTSLSLTFILATRLPLLESWFHGLEKVYTVHKFTAFLSIILLIFHNFSMGGLWGSRLAAQFGNLAIYIFASIILVAYLGKYIQYEAWRWIHRLVYLAYILGLFHIYMIMGNRLLTFNLLSFLVGSYALLGLLAGFYIIFLYQKISFPYLGKITHLKRLNHDTREIQIHLSRPFNYQSGQFAFLKIFQEGFESAPHPFSISGGHGQTLYFTVKNSGDHTKNIYDNLQAGSKVTLDRAYGHMIIEEGRENQVWIAGGIGITPFISYIREHPILDKQVHFYYSFRGDENAVYLDLLRNYAQKNPNFELHLIDSTKDGYLNFEQKEVPEHATVYMCGPISMMKALAKQIKKQNPKTELIYEGFKFK

SEQ ID NO: 49 - protein, 374 aa, Streptococcus pneumoniae PNI0153
MEFSMKSVKGLLFIIASFILTLLTWMNTSPQFMIPGLALTSLSLTFILATRLPLLESWFHGLEKVYTVHKFTAFLSIILLIFHNFSMGGLWGSRLAAQFGNLAIYIFASIILVAYLGKYIQYEAWRWIHRLVYLAYILGLFHIYMIMGNRLLTFNLLSFLVGSYALLGLLAGFYIIFLYQKISFPYLGKITHLKRLNHDTREIQIHLSRPFNYQSGQFAFLKIFQEGFESAPHPFSISGGHGQTLYFTVKNSGDHTNNIYDNLQAGSKVTLDRAYGHMIIEEGRENQVWIAGGIGITPFISYIREHPILDKQVHFYYNFRGDENAVYLDLLRNYAQKNPNFELHLIDSTKDGYLNFEQKKCPNMQPSICVVLFL

SEQ ID NO: 50 - protein, 400 aa, Streptococcus pneumoniae PCS8203
MEFSMKSVKGLLFIIASFILTLLTWMNTSPQFMIPGLALTSLSLTFILATRLPLLESWFHGLEKVYTVHKFTAFLSIILLIFHNFSMGGLWGSRLAAQFGNLAIYIFASIILVAYLGKYIQYEAWRWIHRLVYLAYILGLFHIYMIMGNRLLTFNLLSFLVGSYALLGLLAGFYIIFLYQKISFPYLGKITHLKRLNHDTREIQIHLSRPFNYQSGQFAFLKIFQEGFESAPHPFSISGGHGQTLYFTVKNSGDHTNNIYDNLQAGSKVTLDRAYGHMIIEEGRENQVWIAGGIGITPFISYIREHPILDKQVHFYYSFRGDENAVYLDLLRNYAQKNPNFELHLIDSTKDGYLNFEQKEVPEHATVYMCGPISMMKALAKQIKKQNPKTELIYEGFKFK

SEQ ID NO: 51 - protein, 419 aa, Polymorphum gilvum LMG 25793
MGPLLVALPCLLAALLGFNTYAPYGADAALGIAVGAAAVVAMAQTLILAARPPLVELLFGGLDRMYRVHKWLGISAMVLMILHQQIEPDFERTVRETGLGELGAEAGEFAFNALLALIAVSWFRRLPFIGLEIPYQIWRFSHRFMGALFAIVVFHQFFVDMPTGVDPSLSMLLNTFGIAGVAAWIFTELVAPQLRRREFTVSEISQTGDTTTLTLSPMGRAMRWRPGQFAFVRAPEAGLSEPHPFTIASAPRPDGALTFSIRALGGWTRSLPATLRTGTRVQVEGPYGRFDFRKGGARQIWLAGGIGITPFLAWAESLTEAERRDIHLVHCVRTQEEAIGVETLRAAAARNPRFSFEVVVTTRDGRLTAERLISAAPFAVKDADLWFCGPTGLKDGILKGLKAQNQMPRRVRFEQFEFA

SEQ ID NO: 52 - protein, 468 aa, Bordetella bronchiseptica MO149
MHNGPGANGRLRKRHRARSGDAMRRLRTIFILLVAALSVLWLSQNPPAAWGEGFWAMRKPLIYYTGILALGMMSLGVILAARPARFEGALGGLDKFYRLHKWLGLGGVALALTHWLLKIVPPWMAAQGWTVRPPRVPAPAGQAALYDPFQAWHGVAKSLGEWGLYALLLLAALALYKRFPYRHFFRTHRLMPALYLVFVFHAVVLMAPAYWRGPIGPAMAVVMAAGGAGALLSLLGLIGRPRQAAGRIARLERFADNAVMQVDVQLETRWPGHKAGQFAFVTFDRAEGAHPFTISSAWRDDGLLRFSIKGLGDYTRSLPARLRVGDGVTVEGPYGRFDFRANGRPQILVAGGIGITPFLARLQDMAAARSEGAPAHEVDLVYSTNAPDPDFIGELRALAERARVGLHVLVTQRDGKLTAERLVDMLPRAAQSEVWFCGPAGFGQALREGLAARGMPPACFHQELFEMR

SEQ ID NO: 53 - protein, 468 aa, Bordetella bronchiseptica Bbr77
MHNGPGANGRLRKRHRARSGDAMRRLRTIFILLVAALSVLWLSQNPPGAWGEGFWAMRKPLIYYTGILALGMMSLGVILAARPARFEGALGGLDKFYRLHKWLGLGGVALALTHWLLKIVPPWMAAQGWTVRPPRVPAPAGQAALYDPFQAWHGVAKSLGEWGLYALLLLAALALYKRFPYRHFFRTHRLMPALYLVFVFHAVVLMAPAYWRGPIGPVMAVVMAAGGAGALLSLLGLIGRPRQAAGRIARLERFADNAVMQVDVQLETRWPGHKAGQFAFVTFDRAEGAHPFTISSAWRDDGLLRFSIKGLGDYTRSLPARLRVGDGVTVEGPYGRFDFRANGRPQILVAGGIGITPFLARLQDMAAARSEGAPAHEVDLVYSTNAPDPDFIGELRALAERARVGLHVLVTQRDGKLTAERLVDMLPRAAQSEVWFCGPAGFGQALREGLAARGMPPACFHQELFEMR

SEQ ID NO: 54 - protein, 468 aa, Bordetella bronchiseptica 1289
MHNGPGATGIFRKRHRARSGDAMRRLRTIFILLVAALSVLWLSQNPPGAWGEGFWAMRKPLIYYTGILALGMMSLGVILAARPARFEGALGGLDKFYRLHKWLGLGGVALALTHWLLKIVPPWMAAQGWTVRPPRVPAPAGQAALYDPFQAWHGVAKSLGEWGLYALLLLAALALYKRFPYRHFFRTHRLMPALYLVFVFHAVVLMAPAYWRGPIGPVMAVVMAAGGAGALLSLLGLIGRPRQAAGRIARLERFADNAVMQVDVQLETRWPGHRAGQFAFVTFDRAEGAHPFTISSAWRDDGLLRFSIKGLGDYTRSLPARLRVGDGVTVEGPYGRFDFRANGRPQILVAGGIGITPFLARLQDMAAARSDGAPAHEVDLVYSTNAPDPDFIGELRALAERARVGLHVLVTQRDGKLSAERLVDMLPRAVQSEVWFCGPAGFGQALREGLAARGMPPACFHQELFEMR

SEQ ID NO: 55 - protein, 461 aa, Citreicella sp. 357
MIAASGITRDATMTDAARRDGNVPVPGLPPLSRLSLNSPLALTGPVLVALPCLLAALIGFNTYAPYGADAALGIAVGAAAVVAMAQTLILAARPPLVEPLFGGLDRMYRFHKWLGISAMVLMILHQQIEPDFERLVRETSLGELGEEAGELAFNALLALVAVSWFRRLPFTPLEIPYQIWRFSHRFMGALFAIVVFHQFFVDLPTEVDPSLSVLLNTFGIAGVIAWIFTELVAPYLRRREFTVTEISQTKDTTTLTLRPEGRAMRWRPGQFAFFRAPEAGLSEPHPFTIASAPRPDGTLTFSIRGLGGWTRSLLAILRTGTRVQVEGPYGRFNFRKGGARQIWLAGGIGITPFLAWAESLSEADSRDIHLIHCVRTQEEAIGVETLRAAAARNPRFSFEVVVTTRDGRLTAERLIGAVPFAIRQADLWFCGPTGLKDGILKGLKAQGQTPRRVRFEQFEFT

SEQ ID NO: 56 - protein, 407 aa, Streptococcus cristatus ATCC 51100
MIKIRKENIMKSIKGIALIAVSIVLTIYAWASAGMTNFIVPGLALTTLSLTFLLATRNALLEKWFNGIEKMYAYHKFIAIFSVVLLALHNVAMGGSLWGSHLAGQLGNVGIYLFVSIVLVAYLGKHIKYEAWRWIHRFVYLAYIFGLFHAYMLMGGRLLKPTLLGFVVGFYAIIGLASGFYIIFLYQSLAFRHLGKILQVKRLNHDTVELKIQLSQKLDYQYGQFAFVKIFQEGFEKAPHPFSISGGHDNIVYFTIKNSGDHTKKLYDKIQEGTKVTIDRAYGHMILDQGQEKQIWIAGGIGITPFISYIRENPNLNRPVSFYYAYTGDENAVYLDLLTDYAAKNPQFDLHLVDSKVSGYLDFKNYPLDDKTTVFMCGPVKMMDKLANEFKKTKPKADLVYEGFKFK

SEQ ID NO: 57 - protein, 407 aa, Streptococcus sanguinis SK160
MIKIRKETIMKSIKGIALIAVSIILTIYAWASAGMTNFIVPGLALTTLSLTFLLATRNALLEKWFHGIEKMYAYHKFTAIFSVVLLALHNVAMGGSLWGSHLAAQLGNVGIYLFVSIVLVAYLGKHIKYEAWRWIHRFVYLAYIFGLFHAYMLMGGRLLTPTLLGFIVGFYAIIGLASGFYIIFLYQSLAFRHLGKILQVKRLNHDTVELKIQLSQKLDYQYGQFAFVKIFQEGFEKAPHPFSISGGHDNIVYFTIKNSGDHTKKLYDKIQEGTKVTIDRAYGHMILDQGQEKQIWIAGGIGITPFISYIRENPNLNRPVSFYYAYTGAENAVYLDLLKDYEAKNPQFDLHLIDSKVSGYLDFKNYPLDDKTTVFMCGPVKMMDKLANEFKKTNPKADLVYEGFKFK

SEQ ID NO: 58 - protein, 407 aa, Streptococcus sanguinis SK1059
MIKIRKETIMKSIKGIALIAVSIILTIYAWASAGMTNFIVPGLALTTLSLTFLLATRNALLEKWFHGIEKMYAYHKFTAIFSVVLLALHNVAMGGSLWGSHLAAQLGNVGIYLFVSIVLVAYLGKHIKYEAWRWIHRFVYLAYIFGLFHAYMLMGGRLLTPTLLGFIVGFYAIIGLASGFYIIFLYQSLAFRHLGKILQVKRLNHDTVELKIQLSQKLDYQYGQFAFVKIFQERFEKAPHPFSISGGHDNIVYFTIKNSGDHTKKLYDKIQEGTKVTIDRAYGHMILDQGQEKQIWIAGGIGITPFISYIRENPNLNRPVSFYYAYTGAENAVYLDLLKDYAAKNPQFDLHLVDSKVSGYLDFKNYPLDNQTTVFMCGPVKMMDKLANEFKKTNPKADLVYEGFKFK

SEQ ID NO: 59 - protein, 407 aa, Streptococcus sanguinis SK49
MIKIRKETIMKSIKGIALIAVSIILTIYAWASAGMTNFIVPGLALTTLSLTFLLATRNALLEKWFHGIEKMYAYHKFTAIFSVVLLALHNVAMGGSLWGSHLAAQLGNVGIYLFVSIVLVAYLGKHIKYEAWRWIHRFVYLAYIFGLFHAYMLMGGRLLTPTLLGFVVGFYAIIGLASGFYIIFLYQSLAFRHLGKIIQVKRLNHDTVELKIQLSQKLDYQYGQFAFIKIFQEGFEKAPHPFSISGGHDNIVYFTIKNSGDHTKKLYDKIQEGTKITIDRAYGHMILDQGQEKQIWIAGGIGITPFISYIRENPNLNRPVSFYYAYTGAENAVYLDLLKDYAAKNPQFDLHLVDSKVSGYLDFKNYPLDDKTTVFMCGPVKMMEKLADEFKKTNPKADLVYEGFKFK

SEQ ID NO: 60 - protein, 407 aa, Streptococcus sanguinis SK353
MIKIRKETIMKSIKGIALIAVSIILTIYAWASAGMTNFIVPGLALTTLSLTFLLATRNALLEKWFHGIEKMYAYHKFTAIFSVVLLALHNVAMGGSLWGSHLAAQLGNVGIYLFVSIVLVAYLGKHIKYEAWRWIHRFVYLAYIFGLFHAYMLMGGRLLTPTLLGFVVGFYAIIGLASGFYIIFLYQSLAFRHLGKIIQVKRLNHDTVELKIQLSQKLDYQYGQFAFIKIFQEGFEKAPHPFSISGGHDNIVYFTIKNSGDHTKKLYDKIQEGTKVTIDRAYGHMILDQGQEKQIWIAGGIGITPFISYIRENPNLNRPVSFYYAYTGAENAVYLDLLKDYAAKNPQFDLHLVDSKVSGYLDFKNYPLDNQTTVFMCGPVKMMEKLADEFKKTNPKADLVYEGFKFK

SEQ ID NO: 61 - protein, 407 aa, Streptococcus sanguinis SK115
MIKIRKETIMKSIKGIALIAVSIILTIYAWASAGMTNFIVPGLALTTLSLTFLLATRNSLLEKWFHGIEKMYAYHKFTAIFSVVLLALHNVAMGGSLWGSHLAAQLGNVGIYLFVSIVLVAYLGKHIKYEAWRWIHRFVYLAYIFGLFHAYMLMGGRLLTPTLLGFVVGFYAIIGLASGFYIIFLYQSLAFRHLGKILQVKRLNHDTVELKIQLSQKLDYQYGQFAFVKIFQEGFEKAPHPFSISGGHDNIIYFTIKNSGDHTKKLYNNIQEGTKVTIDRAYGHMILDQGQEKQIWIAGGIGITPFISYIRENPNLNRPVSFYYAYTGAENAVYLDLLKDYAAKNPQFDLHLVDSKVSGYLDFKNYPLDDKTTVFMCGPVKMMDKLANEFKKTNPKAELVYEGFKFK

SEQ ID NO: 62 - protein, 450 aa, Vibrio cholerae 2740-80
MIKWNWVMSRVKYTLWVVVGIVTLLWVQAEPTLFGSTNLFQWRSGLVQFSGILALMLMSLAMLLALRLPLIEQWTQGIDKGYRIHKWLGISALLLGIFHWLAYHLPKWLISLELLTKPARLNGSGPNSNLSGLALWLKEAKPLAMEIGEWGFYALIVLLVVSLWSAIKYKPFRLTHRLMAVVYLLIALHSVILLKKAYWGEPIYWLTMLFIVVGSWAACYSLLGLVGRQSRYPAHVKAFHYCPNSQTLDLTIQLDKPWLGHKAGQFAYLKFAGEEPHPFTIACAHQGSQLRFLIKELGDFTTGLHQRLQNGKSLEVEGPYGKFDFSTQQPQIWIGGGVGIAPFMAGLDWLMRERAHPPVHLFFCCHQIDPDLCAELRHKAQLAGVSLTIIDSSVDPHLSADDIARRCGDLSRFEIYFCGPIAFSNSLKKALKPYQVDLSRQFHEEQFVMR

SEQ ID NO: 63 - protein, 439 aa, Thauera phenylacetica B4P
MIPALSAFIGILALAWGLNVAALDGGSASLPWLVREQGLYLSGLLAIGLMSLAMVLATRPTVLERPLGGMDRIFRLHKWAGILAAVFAALHWLIEMSDDVIKSLYGKAGKPAHDEFGGLYEMLRDAGEELGEFAIYLVLAMVVLSLWKRFPYKFWRHLHRAMPVFYLLLAFHAAVLAPPDYWTQPVGVLLALLLAAGTVASVIALAGRIGHDRKVQGVVTAVSSPVPDVTEIVCRLDGAWRGHQAGQFAFVGLEGFEGSHPFTIASADHGDRSLTFQIKALGDYTRQLASRVAVGQAVTIEGPYGRFVLGRQDPKARQIWVAGGIGVTPFLAWLDALRADPAAAPAVELHYSTRGAAHDPFIERLRSLCAGLPSVSLHIHDRADGDDLTPERLAATATDGQRAEVWFCGPRGFGDQLKAGLARQWGRRLSFRREAFEMR

SEQ ID NO: 64 - protein, 446 aa, Thauera terpenica 58Eu
MIPLLSAFLAVLTLAWGVNAVSLDASQTTLPWLIREQGLYLSGLLSIGLMSLAMVLATRPVILERPLGGMDRIFRVHKWAGILAAVFAALHWLIEMSDDLIKAVYGRAGRPPKMEFGSVYEALRDAGEALGEFAIYVVLAMIVLSLWKRFPYKFWRLLHRAMPALYLVLAFHAAVLAPPDYWSQPVGVLLAVLLAAGVVAAVITLSGRIGHDRRVHGVVTAVSSPAADITEVVCRLGGEWRGHRAGQFAFVSFVGLDHLEGAHPFTIASADHGDRLLSFQIKALGDHTRRVAHQVQVGQAVTVEGPYGRFVLERRNRKARQIWVAGGIGVTPFLAWLDELRANTEPASCAATPVDLHYGTRSAAQDPFVGRLQALCAALPAVRLHIHDSATGARLTADTLASTQSDGGHTEVWFCGPPSLGDQLKAGLKQLWRRRVRFHREAFEMR

SEQ ID NO: 65 - protein, 445 aa, Thauera sp. MZ1T
MIPTLSTLPALAAFVALVAAAWGLNVAALDGGIASLPWLIREQGLYLSGLLAIGLMSLAMVLATRPTVLERPLGGMDRIFRLHKWAGILAAVFAALHWLIEMSDDVIKSLYGKAGKPAHDEFGGLYEMLRDAGEELGEFAIYLVLAMVVLSLWKRFPYKFWRHLHRAMPVFYLLLAFHAAVLAPPDYWTQPVGVLLALLLAAGTVASVIALTGRIGHDRKVQGVVTAVSSPAPDVTEIVCRLDGAWRGHQAGQFAFVGLERFEGSHPFTIASADHGDRSLTFQIKALGDYTRQLASRVAVGQAVTVEGPYGRFVLGRQDHKARQIWIAGGIGVTPFLAWLDALRADPAAAPTVELHYSTRGAAHDPFVERLRSLCAELPSVSLHIHDRAAGDDLTPERLATTATDGQRAEVWFCGPRGFGDQLKAGLARLWGRRLSFRREAFEMR

SEQ ID NO: 66 - protein, 445 aa, Thauera aminoaromatica
MIPTLSTLPALAAFVALVAAAWGLNVAALDGGTASLPWLIREQGLYISGLLAIGLMSLAMVLATRPTVLEHPLGGMDRIFRLHKWAGILAAVFAALHWLIEMSDDVIKSLHGKAGKPAHNEFGGLYEMLRDAGEELGEFAIYLVLAMVVLSLWKRFPYKFWRHLHRAMPVFYLLLAFHAAVLAPPDYWTQPVGVLLALLLAAGTVASVIALTGRIGHDRKVQGVVTAVSSPAPDVTEIVCRLDGAWRGHQAGQFAFVGLERFEGSHPFTIASADHGDRSLSFQIKALGDYTRQLASRVAVGQAVTVEGPYGRFVLGRQDHKARQIWVAGGIGVTPFLAWLDALRADPAAAPAVELHYSTRGAAQDPFVERLRSLCAGLPSVTLHIHDRAAGDDLTPERLAATATDGQRAEVWFCGPRGFGDQLKAGLARLWGRRLSFRREAFEMR

SEQ ID NO: 67 - protein, 439 aa, Aromatoleum aromaticum EbN1
MIPTLTALIAIVAGVWGWDLAVNGAGSGSMPWVVYEQGLYLSGLLAIAMMSLAMVMATRPPGVERLLGGMDRAYRLHKWAGILAAGFASLHWLLEMSDDLIEERYGEAGRTSDENVSGVLDTLRDTGEELGEFAIYLVLAMIVLALWKRFPYKFWRHIHRAMPVLYLMLAFHAAVLAPTAYWSEPAGLLLAGALSAGTLAAVWSLAGRIGRGRQAHGVVTAVASPAPDVTEVVCRLDGNWRGHHAGQFAFVTFNRIEGAHPFTIASADQGDHSVGFQIKALGDYTRELSRRIAVGQAVTVEGPYGRFELARQDRKARQIWVAGGIGITPFLAWLDALRANPAAAPVADLHYCTRAGSDDPFVGRLETLCRDLPSVTLHVHDTARHGVLTAERLATLHDCRQRAEVWFCGPRAFAEQLRNGLARAWLGHLRFHQEAFDMR

SEQ ID NO: 68 - protein, 439 aa, Thauera sp. 28
MIPVLSAFIGILALAWGLNVAALDGGTASLHWLVREQGLYLSGLLAIGLMSLAMVLATRPAMLERPLGGMDRIFRLHKWAGILAAVFAALHWLVEMSDDVIKSIYGRTGRPAHDEFGGLYELLRDAGEEAGEFAIYLVLAMVVLSLWKRFPYKFWRHLHRAMPVFYLLLAFHAAVLAPPSYWTQPVGVLLALLLAGGTVASLIALTGRIGRHRKVQGVVTAVSSPAPDVTEIVCRLDDAWPGHQAGQFAFIGFERFEGAHPFTIASADHGNRSLTFQIKALGDYTRQLASRVAVGQAVTVEGPYGRFVLGRQDHTARQIWIAGGIGVTPFLAWLDALRAAPAAAPPVELHYSTRSAAQDPFVERLRSLCAELPSVRLHIHDRAAGDDLTPERLAATATTGQRAEVWFCGPRGFGDQLKAGLARLWGRRLRFRREAFEMR

SEQ ID NO: 69 - protein, 439 aa, Thauera sp. 27
MIPVLSAFIGILALAWGLNVAALDGGTASLPWLVREQGLYLSGLLAIGLMSLAMVLATRPTMLERPLGGMDRIFRLHKWAGILAAVFAALHWLVEMSDDVIKSIYGRTGRPAHDEFGGLYELLRDAGEEVGEFAIYLVLAMVVLSLWKRFPYKFWRHLHRAMPVFYLLLAFHAAVLAPPSYWTQPVGVLLALLLAGGTVASLIALTGRIGRHRKVQGVVTAVSSPAPDVTEIVCRLDDAWPGHQAGQFAFIGFERFEGAHPFTIASADHGNRSLTFQIKALGDYTRQLASRVAVGQAVTVEGPYGRFVLGRQDHTARQIWIAGGIGVTPFLAWLDALRAAPAAAPPVELHYSTRRAAQDPFVERLRSLCAELPSVRLHIHDRAAGDDLTPERLATTATTGQRAEVWFCGPRGFGDQLKAGLARLWGRRLRFRREAFEMR

SEQ ID NO: 70 - protein, 442 aa, Thauera sp. 63
MISVLSGFITILALAWGLNAAALDGGQTSLPWLIREQGLYLSGLLSIGLMSLAMVLATRPVILERPLGGMDRIFRLHKWAGILAAVFAALHWLIEMSDDLIKALYGRSGRPAEMAFGGLLETLRDAGEELGEFAIYLVLGMIVLSLWKRFPYKFWRHLHRAMPALYLLLAFHAAVLAPLDYWSQPVGMLLALLLASGTVAAVIALSGRIGRDRRVQGEVTAVSSPAPDVTEVVCRLGGEWRGHRAGQFAFVAFTGLDRFEGAHPFTIASADHGDRTLTFQIKALGDHTRQLAGRVAVGQPVTVEGPYGRFVLERRDRKARQVWVAGGIGVTPFLAWLDELRTRRDTAVPVELHYSTRAATQDPFVARLRTLCADLPDVTLHVHDSSAGTGLKPEAFATAQADGTRTEVWFCGPSGLGDQLKAALARLWNRRVRFHREAFEMR

SEQ ID NO: 71 - protein, 461 aa, Pelagibaca bermudensis 13377
MIVATAITRDTTMTDTAHRDGNVSAPGFPPLLRLSLNSTLALTGPVLVALPCLLAALLGLNTYAPYGADAAFGIAVGAAAVVAMAQTLILAARPPLVEQLFGGLDRMYRVHKWLGISAMVLMILHQQIEPDFERLVRETSLGELGEEAGELAFNALLALVAVSWFRRLPFIGLEIPYQLWRFSHRFMGALFAIVVFHQFFVDVPAGVDPTFMLVLNSFGIAGVVAWIFTELLAPHLRRRDFTVSQISQTGDTTTLMLTPKGRAMRWRPGQFAFVRAPEAGLSEPHPFTIASAPRPDGSLTFSIRALGGWTRSLPATLRTGTRVQVEGPYGRFDFRKGGARQIWLAGGIGITPFLAWAESLTEAERRDIHLVHCVRTQDEAIGLETLRAAAARNPSFSFEVVVTARDGRLTAERLIGAVPFAIRQADLWFCGPTGLKDGILKGLKAQGQTPRRVRFEQFEFA

SEQ ID NO: 72 - protein, 439 aa, Photobacterium profundum
MKALYIKMMGVFVLISLLWLQAESNLFSYTNFFEYRSALIQFSGIIAITLMTMVMLLALRLSFIERLTQGLDKSYHLHKWMGIGALVTAVIHWMIAIVPKYLVRWDMLEKPVRTQNVLNPDSLYSIIRPLRSGAEGLGEWAFYVMLVLGGISLLGAIGYKTFKLSHKLMSACFLVIAYHSAILIKHSYWPYIITYLILAIIACGMFAAVWSLCGKIGKKRAFKAHVSGFSHDNDNQVTDLRLSVKDWPGHRRGQFAYVNIGNHEPHPFTIASVDRSDGQLRFLVKELGDFTAKLKTQLVLGQSATIEGPYGQFNFDDTHPQIWIGGGIGIATFKAALQQRQNSSAIKPVTLYYCTSNPSSRFISELEREAIKAHVTLKIIDGRSQPYLTVDQLLSRHPDIQCNSIWFCGPIAFSNQLTQDLTAIGYDLDLFHREYFSMR

SEQ ID NO: 73 - protein, 408 aa, Bacillus sp. B14905
MKAYRGLLLIILAMGSSACLWYFATPLTPIHPLNKLAHIIGGLAITGLFLVFLFSTRMKILERWFHGLERLNFYHKVLAMLSLAFIIIHGQLQKMVPDEDLPQTSFREWAKELGEFAQYGFIILIALAFLAKFLKYEHWRWLHRLLLLPYTLGIYHTYFSSEYDLLQPSALGIFTALTTTIGFMSALYMLTMYQDMFFPYNGTISNIQKLNAHVIELELTLTKKLHYRPGQFLFLKIFQEGIEKAPHPFSISGGDGVTIRVTIKAVGDFTKQVYNEIQVDTPVAIDGPFGHFDFAKGANQQLWIAGGIGITPFIAYLQTKPTKKIDLYYSFHGVDNIVYKDFLLDYAQSNEQFTVTFIDTSQVDRLSFDQLTIPAHTSIYLCGPEKMMKHFKSSAPTSHIEWAAFKLR

SEQ ID NO: 74 - protein, 446 aa, Thauera sp. 63
MKHIQFAYAGLLLLLSLLWWLADPLLPNGYEYFALRTVAINYTGVIGMGVMSVGMILALRPVRIEPLLDGLDKTYRLHKWLGITGLVFSVVHWLWAQGTKWAVGWGWLVKPERGPRPELTDPVEIFLRAQRGLAESVGEWAFYAAVALIVIALVKRFPYRLFFKTHRLLALAYLALVFHSVVLTPFGYWTQPMGVVLALLMAGGSVAAVVSLTGRVGHRRKAVGEIEELVNFADNRVLKVAIRFKDRWPGHEAGQFAFVTFSTDEGAHPFTISSGWQGDGRLFFLIKGIGDYTARLPELLRVGDLVTVEGPYGRFDFANAGASDKRRQIWVGGGIGITPFIARMKALAVMPDGREVDLFYSTAEPDDEFIQRLQRDAQAAGVKLHVLVSARDGRLDVARICETVPGWAEADVWFCGPGGFGQALREGFFARGLAAKDFHQELFDMR

SEQ ID NO: 75 - protein, 441 aa, Laribacter hongkongensis HLHK9
MKIKNHPLIWGGAVIVLAYVVSRAMVVSWPNDFWAWRKEVVLLSGVIMLAAMSVAGVLALRTPWLEQQLGGLDRTYRLHKYLGITAGVMLAVHWLTELSPGTLIDWGWLAPRVKGPKGPQATDLLSTLKGPAKDFGEWAAWAMLALVPLALWKAPYKPWRLVHKAMAVILAMGVFHGLVLLPRNHWLTPVGGLMLVIVVAGAVAAVWSLTGRIGRQRQSAGVISAIDRPAPDTLQLTCRLDHDWAGHAAGQFAFLTLDAGEGAHPFTIASADHGDGEIRFVIKALGDYTRKLAQKVQVGQKVRVEGPYGAFHLPEADGHRQVWVAGGVGVTPFMAWLDALAARGEKRTDVDFCYCVPNRRDAVALDELQRNAERVGVRLHVFASREGERLGVQHPVFSERDQVRPRVWFCGPARLGDALKTGLMQKGFAADSFHHEAFDFR

SEQ ID NO: 76 - protein, 441 aa, Escherichia coli UMEA 3124-1
MKKANLTGTLVCFVACIIFLSSGDIFREKPIALIWFIRQNTLFFTGTLAWCLMTLTMCLSLRSSWLNKMLGGLDKAWRLHKWAGICAIAFAFAHWLDEKLPQLFVAFGWLTHPGKIVDINLTPVQENWLHAGLLAGECAMFIMIAMVFVSLSKKVPYHLFHLVHRLFPVFYLAIAFHVFTALFKSYWWETPAAYLLILITIPGVFVAFISLLKLNGNKNKHQATIKSIVNHPGQITEVILELEHAIDYSPGQFAFLTFAHSKESHPFTIASYAIEKNTLRFAIKNLGDYTSTLASSIKIGQSALVEGPWGKFDFTLPCSRQVWIAGGIGITPFIAQLEYLNQHGASRVPVDLWYCVSRSEDAWYVDKLTSLCAQASVTLHLLDAHKGERLQSHYLTDKIANKGDTHFWFCGPQSFAKALSKGLYENGIASQNFHYDRFCMR

SEQ ID NO: 77 - protein, 441 aa, Escherichia coli BWH 32
MKKANLTGTLVCFVACIIFLSSGDIFREKPIALIWFLRQNILFFTGTLAWCLMTLTMCLSLRSSWLNKVLGGLDKAWRLHKWAGICAIAFAFAHWLDEKLPQLFVAFGWLTHPGKIVDINLTPVQENWLHAGLLAGECAMFIMIAMIFVSLSKKVPYHLFHLVHRLFPVFYLAIAFHVFTALFKSYWWETPAAYLLILITIPGVFAAFISLLKLNGSKNKHQATIKNIVNHPGQITEVTLELEHAIDYSPGQFAFLTFAHSKESHPFTIASYTKEKNTLRFAIKHLGDYTSTLASSIKIGQSAFVEGPWGKFDFTLPCSHQVWIAGGIGITPFIAQLEYRKHHGASFVPVDLWYCVSRSEDAWYIDKLTSLCAQARVTLHLLDAHKGERLQVHYLTDKIANKGDTHFWFCGPQSFAKALSKGLYENGIASQNFHFDRFCMR

SEQ ID NO: 78 - protein, 339 aa, Escherichia coli KTE193
MKKANLTGTLVCFVACIIFLSSSDIFREKPIALIWFIRQNTLFFTGTLAWCLMTLTMCLSLRSSWLNKVLGGLDKAWRLHKWAGICAIAFAFAHWLDEKLPQLFVAFDWLTHPGKIVDINLTPVQENWLHAGLLAGECAMFIMIAMVFVSLSKKVPYHLFHLVHRLFPVFYLAIAFHVFTALFKSYWWETPAAYLLILITIPGVFAAFISLLKLNGNKNKHQATIKSIVNHPGQITEVILELEHVIDYSPGQFAFLTFAHSKESHPFTIASYAIEKNTLRFAIKNLGDYTSTLASSITIGQSALVEGPWGKFDFTLPCSRQVWIAGGIGITPLSPSLSI

SEQ ID NO: 79 - protein, 339 aa, Escherichia coli STEC_MHI813
MKKANLTGTLVCFVACIIFLSSSDIFREKPIALIWFIRQNTLFFTGTLAWCLMTLTMCLSLRSSWLNKVLGGLDKAWRLHKWAGICAIAFAFAHWLDEKLPQLFVAFGWLTHPGKIVDINLTPVQENWLHAGLLAGECAMFIMIAMVFVSLSKKVPYHLFHLVHRLFPVFYLAIAFHVFTALFKSYWWETPAAYLLILITIPGVFAAFISLLKLNGNKNKHQATIKSIVNHPGQITEVILELEHVIDYSPGQFAFLTFAHSKESHPFTIASYAIEKNTLRFAIKNLGDYTSTLASSITIGQSALVEGPWGKFDFTLPCSRQVWIAGGIGITPLSPSLSI

SEQ ID NO: 80 - protein, 441 aa, Escherichia coli KTE147
MKKANLTGTLVCFVACLIFLSSGDIFREKPIALIWFLRQNILFFTGTLAWCLMTLTMCLSLRSSWLNKVLGGLDKAWRLHKWAGICAIAFAFAHWLDEKLPQLFVAFGWITHPGKIVDINLTPVQENWLHAGLLAGECAMFIMIAMIFVSLSKKVPYHLFHLVHRLFPVFYLAIAFHVFTALFKSYWWETPAAYLLILITIPGVFAAFISLLKLNDSKNKHQATIKNIVNHPGQITEVTLELEHAIDYSPGQFAFLTFAHSKESHPFTIASYTKEKNTLRFAIKHLGDYTSTLASSIKIGQSAFVEGPWGKFDFTLPCSHQVWIAGGIGITPFIAQLEYRKHHGASFVPVDLWYCVSRSEDAWYIDKLTSLCAQARVTLHLLDAHKGERLQVHYLTDKIANKGDTHFWFCGPQSFAKALSKGLYENGIASQNFHFDRFCMR

SEQ ID NO: 81 - protein, 441 aa, Escherichia coli KTE143
MKKANLTGTLVCFVACLIFLSSGDIFREKPIALIWFLRQNILFFTGTLAWCLMTLTMCLSLRSSWLNKVLGGLDKAWRLHKWAGICAIAFAFAHWLDEKLPQLFVAFGWLTHPGKIVDINLTPVQENWLHAGLLAGECAMFIIIAMVCVSLSKRVPYHLFHLVHRLFPVFYLAIAFHVFTALFKSYWWETPAAYLLILITIPGVFAAFISLLKLNGSKNKHQATIKNIVNHPGQITEVTLELEHAIDYSPGQFAFLTFAHSKESHPFTIASYTKEKNTLRFAIKNLGDYTSTLASSIKIGQSAFVEGPWGKFDFTLPCSHQVWIAGGIGITPFIAQLEYRKHHGASSVPVDLWYCVSRSEDAWYVDKLTSLCAQARVTLHLLDAHKGERLQAHYLTDKIANKGDTHFWFCGPQSFAKALSKGLYENGIASQNFHYDRFCMR

SEQ ID NO: 82 - protein, 441 aa, Escherichia coli KTE98
MKKANLTGTLVCFVACLIFLSSGDIFREKPIALIWFLRQNILFFTGTLAWCLMTLTMCLSLRSSWLNKVLGGLDKAWRLHKWAGICAIAFAFAHWLDEKLPQLFVAFGWLTHPGKIVDINLTPVQENWLHAGLLAGECAMFIIIAMVCVSLSKRVPYHLFHLVHRLFPVFYLAIAFHVFTALFKSYWWETPAAYLLILITIPGVFAAFISLLKLNGSKNKHQATIKNIVNHPGQITEVTLELEHAIDYSPGQFAFLTFAHSKESHPFTIASYTKEKNTLRFAIKNLGDYTSTLASSIKIGQSAFVEGPWGKFDFTLPCSHQVWIAGGIGITPFIAQLEYRKHHGASSVPVDLWYCVSRSEDAWYVDKLTSLCAQARVTPHLLDAHKGERLQAHYLTDKIANKGDTHFWFCGPQSFAKALSKGLYENGIASQNFHYDRFCMR

SEQ ID NO: 83 - protein, 441 aa, Escherichia coli FVEC1412
MKKANLTGTLVCFVACLIFLSSGDIFREKPIALIWFLRQNILFFTGTLAWCLMTLTMCLSLRSSWLNKVLGGLDKAWRLHKWAGICAIAFAFAHWLDEKLPQLFVAFGWLTHPGKIVDINLTPVQENWLHAGLLVGECAMFIMIAMIFVSLSKKVPYHLFHLVHRLFPVFYLAIAFHVFTALFKSYWWETPAAYLLILITIPGVFAAFISLLKLNGSKNKHQATIKNIVNHPGQITEVTLELEHAIDYSPGQFAFLTFAHSKESHPFTIASYTKEKNTLRFAIKHLGDYTSTLASSIKIGQSAFVEGPWGKFDFTLPCSHQVWIAGGIGITPFIAQLEYRKHHGASFVPVDLWYCVSRSEDAWYIDKLTSLCAQARVTLHLLDAHKGERLQVHYLTDKIANKGDTHFWFCGPQSFAKALSKGLYENGIASQNFHFDRFCMR

SEQ ID NO: 84 - protein, 421 aa, Clostridium sp. DL-VIII
MKKKLGITIILLSMAITWITWLFIEPTREISAMTGYSQLLASFALIAFAFINFISTRHKILDNLFDGLDRSYIYHRYLSISALLLAIFHNITMDIGKRAERASGIKGVKDPYAMFGTFSMYLFIALIIIAIVAKKLNYERWKTIHKFMIIPYAFGIYHYYGSATYAVFSIRPYAIWMDIINLIGLISVAYSTFFYEKLSFKYKYKVQKLESVANGTLEITGTALGNDMEFKPGQFAFLKILDKDNKFLSHPFTISQAPKKGYIQFTIKALGDDTKALYDNLKVGSEFSVSGPHGKFDYRTGAKNQIWIAGGIGVTPFRSFAQSNIDKNFSIDFFYAYNNEAEGAYTDELQALSKDNLRIHLCNSKEKGFLSVKEISNFVNIKDDIEVYFCGPKPMRENLKKQFKDSNFNISNFNYEHFQFK

SEQ ID NO: 85 - protein, 421 aa, Clostridium saccharoperbutylacetonicum N1-4
MKKKPGILLILFSMIITWALWVFIKPTREISTLSEYSQLIASFALVAFALINFISTRNKILDVLFDGLDKSYIYHKYLSISALVLVIIHNITIELGKGIERSQGIPIPRDPYAMYGAFSMYLFIILVLIAIIAKKLNYERWKAIHKFMIIPYAMGIYHYYGSATYAVFSFKPFNIWLNIVNIMGISSVIYSIFLYEKISFKYKYKVSSLNIVADGTLEITGSALKKDIDYKPGQFAFIKTLQNDNKFVSHPFTISEAPKKGELQFTIKGLGDHTKELFDTLKVGDKFEVSGPHGKFNYKSGRKRQVWIAGGIGVTPFRSFSQAEIPKDFLVDFFYAFNNEEESAYSEELEGLQRDNLRVHLFNSKEKGFLSVSEIEKYIDTKDTIDIYFCGPAPMRESLRKQFANSHLNIGELHYEHFQFK

SEQ ID NO: 86 - protein, 421 aa, Clostridium sp. Maddingley MBC34-26
MKKRLGIVLIILFMAVTWIFWLMVQPTRTISSMTGYSQLLAAFALVAFAFINFISTRHGILDNLFDGLDKSYIYHKYLSISALILVVIHNITISIGKSDERALGIKGVRDPYAMYGTFSMYLFIILIIIALVAKKLNYERWKVIHKLMIIPYAMGIYHYYGSATYNVFSIEPFSIWLDTVNLIGILSVIYSIFFYEKTSFKYKYKVSTLEKVANGTLEITGTALGKDMNFKPGQFAFLKILDGKNKFLSHPFTISQAPKKGELQFTIKALGDDTKELFNSLEIGNEFVVSGPHGKFNYENGEQNQIWIAGGIGVTPFRSFSQSDINKNFSIDFFYAYNNNEEGAYVDELQSISRDNLRIHLFNSKEKGFLSVEEITKHVKTKDKVDVYFCGPKPMRDNLIKQFKDSELNVSNFYFEHFQFK

SEQ ID NO: 87 - protein, 434 aa, Clostridium acetobutylicum strain EA 2018
MKKYQGLILILVTFLLTYIFWLFETPEKSLSLYRRYSQFISSIALIALTWINFIATRHHYVDDFFNGLDISYIYHKYLSILIVFLIWAHNFTLKMGGFSGKRPTNFKSLPKGVKPSGAGMFFSGKQLGTFSLYLFTGLVIIFLVLYKLEYENWKKFHTIMIVPYILGVLHYYLSSEYKVFSLSAFSLWMNLFNLIGVLSIIYSIFIYEFVSFKHKYKVTSINEIAKDTFEITGTSLKNELKYKAGQFAFIKIPEKKSFFPSHPFTMSNSNKSNEIQFSIKVLGDHTKALKENLKVGDTLSVSGPHGKFNYENGLKHQIWIAGGIGITPFRSFWQAELPSDYTVDLFYTYNNENEGAYINELNSINKNSNLNIHSIDSSKNGFLGLEDLEKHIDKNLEYSVFFCGPKPMREKLRRDFEKVNFKIKDMNYEHFHFK

SEQ ID NO: 88 - protein, 424 aa, Desulfitobacterium metallireducens DSM 15288
MKLKGKLGIFSIFFSVLITIMFWSFEQPVKDLAFIGQVSQLLGTLALLGFAWNNFISTRQPILDKLFDGLDQSYIYHKYLSIISLALAMVHAMTIGMSKAQNLAPGTRPVKSIFIVLGSPSMTLFIILVIVAFMAKKIDYEKWKSIHKLVLIPYVIALFHYYGSSSYVVFGVTPFSLWINIVNAIGVISAVYSLFIYEKSSFKYRYKVVNTQFVAKGMLQISGKPIGENLNYKAGQFAFLKFVDAKLKFPSHPFTISEAPHKDEIQFTIKSLGDHTGSLLKNLKVGDEFAVENAHGQFNYLTGTPHQIWIAGGIGITPLRSFYQTQIPKEFSIDFFYAYNNDQEGAYVEEINSLPKRDNFRVHLYDSSKIGFLTAAEVAKHMSKDVSVDVYFCGPKPMRESLRKGFETGNLKVNALYFEEFQFR

SEQ ID NO: 89 - protein, 434 aa, Pseudomonas aeruginosa PA7
MKLLWGVLAAALAAWGLTLAIDPPASLDIWVVRKQAILLTGVASFALMSLIMLLAVRPTWLEKPLDGLDRMYRLHKWAGILAIVLGLLHYLLELGGPLLASIVAKPAKGPRVETFLDVFRGSAKDLGEWSAWILGGMLLITLWQRFPYHLWRHVHKALALVYLVLAFHSVVLAPASYWSQPAGWLVAACALLGSACALLSLSGRIGRARRHAGVVTAVERRGESLLEVTCRLQGDWSHRAGQFAFLTCDRLEGAHPFTIASADHGCGEVRFSIKALGDYTRRLQANLDVGARVEVEGPYGCFDFRRGLAGRQVWVAAGIGVTPFIAWLESLQAAPESAPSVELHYCVRNSQEALFAGRLRELCERLPSVALHIRYSDEQGKPQAAQLGMLKNAEGRWPSVWFCGPQGLADSLRRELRRQGMPLRLFHQEAFRMR

SEQ ID NO: 90 - protein, 434 aa, Pseudomonas sp. 2_1_26
MKLLWGVLAAALAAWGLTLAVDPLASLDIWVVRKQAILLTGVASFALMSLIMLLAVRPVWLEKPLDGLDRMYRLHKWAGILAIVLGLLHYLLELAGPWLAGIVGKPVKGPRVETFLDVFRGSAKELGEWSAWILGGMLLITLWQRFPYHLWRYVHKALALVYLVLAFHSVVLAPASYWSQPAGWLVAACALLGSACALLSLSGRIGRARRHAGVVTAVERRGESLLEVTCRLQGDWSHRAGQFAFLTCDRLEGAHPFTIASADRGCGEVRFSIKALGDYTRRLQDNLEVGARVEVEGPYGCFDFRRGLAGRQVWVAAGIGVTPFIAWLESLQAAPESAPSVELHYCVRNSQEALFAGRLRELCEHLPSVTLHIRYSDDQGKPQAAQLGVLKSAEGRWPSVWFCGPQGLADSLRRDLRRQGMPLRLFHQEAFRMR

SEQ ID NO: 91 - protein, 434 aa, Pseudomonas sp. P179
MKLLWGVLAAALAAWGLTLAVDPPASLDIWVVRKQAILLTGVASFALMSLIMLLAVRPAWLEKPLDGLDRMYRLHKWAGILAIVLGLLHYLLELAGPWLAGIVGKPVKGPRVETFLDVFRGSAKELGEWSAWILGGMLLVTLWQRFPYHLWRYVHKALALVYLVLAFHSVVLAPASYWSQPAGWLVAACALLGSACALLSLSGRIGRTRRHAGVVTAVERHGESLLEVTCRLQGDWSHRAGQFAFLTCDRLEGAHPFTIASADRGCGEVRFSIKALGDYTRRLQDNLEVGARVEVEGPYGCFDFRRGLAGRQVWVAAGIGVTPFIAWLESLQAAPESAPSVELHYCVRNSQEALFAGRLRELCEHLPSVTLHIRYSDEQGKPQAAQLGVLKSAEGRWPSVWFCGPQGLADSLRRDLRRQGMPLRLFHQEAFRMR

SEQ ID NO: 92 - protein, 434 aa, Pseudomonas aeruginosa BL25
MKLLWGVLAAALAAWGLTLAVDPPASLDIWVVRKQAILLTGVASFALMSLIMLLAVRPVWLEKPLDGLDRMYRLHKWAGILAIVLGLLHYLLELAGPWLAGIVGKPVKGPRVEAFLDVFRGSAKELGEWSAWILGGMLLITLWQRFPYHLWRYVHKALALVYLVLAFHSVVLAPASYWSQPAGWLVAACALLGSACALLSLSGRIGRTRRHAGVVTAVERRGESLLEVTCRLQGDWSHRAGQFAFLTCDRLEGAHPFTIASADRGCGEVRFSIKALGDYTRRLQDNLEVGARVEVEGPYGCFDFRRGLAGRQVWVAAGIGVTPFIAWLESLQAAPESAPSVELHYCVRNSQEALFAGRLRELCEHLPSVTLHIRYSDEQGKPQAAQLGVLKSAEGRWPSVWFCGPQGLADSLRRDLRRQGMPLRLFHQEAFRMR

SEQ ID NO: 93 - protein, 434 aa, Pseudomonas aeruginosa 2192
MKLLWGVLAAALAAWGLTLAVDPPASLDIWVVRKQAILLTGVASFALMSLIMLLAVRPVWLEKPLDGLDRMYRLHKWAGILAIVLGLLHYLLELAGPWLAGIVGKPVKGPRVETFLDVFRGSAKELGEWSAWILGGMLLITLWQRFPYHLWRYVHKALALVYLVLAFHSVVLAPASYWSQPAGWLVAACALLGSACALLSLSGRIGRARRHAGVVTAVERHGESLLEVTCRLQGDWSHRAGQFAFLTCDRLEGAHPFTIASADRGCGEVRFSIKALGDYTRRLQDNLEVGARVEVEGPYGCFDFRRGLAGRQVWVAAGIGVTPFIAWLESLQAAPESAPSVELHYCVRNSQEALFAGRLRELCEHLPSVTLHIRYSDEQGKPQAAQLGVLKSAEGRWPSVWFCGPQGLADSLRRDLRRQGMPLRLFHQEAFRMR

SEQ ID NO: 94 - protein, 434 aa, Pseudomonas aeruginosa ATCC 700888
MKLLWGVLAAALAAWGLTLAVDPPASLDIWVVRKQAILLTGVASFALMSLIMLLAVRPVWLEKPLDGLDRMYRLHKWAGILAIVLGLLHYLLELAGPWLAGIVGKPVKGPRVETFLDVFRGSAKELGEWSAWILGGMLLITLWQRFPYHLWRYVHKALALVYLVLAFHSVVLAPASYWSQPAGWLVAACALLGSACALLSLSGRIGRARRHAGVVTAVERHGESLLEVTCRLQGDWSHRAGQFAFLTCDRLEGAHPFTIASADRGCGEVRFSIKALGDYTRRLQDNLEVGARVEVEGPYGCFDFRRGLAGRQVWVAAGIGVTPFIAWLESLQAAPESAPSVELHYCVRNSQEALFAGRLRELCERLPSVILHIRYSDEQGKPQAAQLGVLKSAEGRWPSVWFCGPQGLADSLRRDLRRQGMPLRLFHQEAFRMR

SEQ ID NO: 95 - protein, 434 aa, Pseudomonas aeruginosa VRFPA04
MKLLWGVLAAALAAWGLTLAVDPPASLDIWVVRKQAILLTGVASFALMSLIMLLAVRPVWLEKPLDGLDRMYRLHKWAGILAIVLGLLHYLLELAGPWLAGIVGKPVKGPRVETFLDVFRGSAKELGEWSAWILGGMLLITLWQRFPYHLWRYVHKALALVYLVLAFHSVVLAPASYWSQPAGWLVAACALLGSACALLSLSGRIGRARRHAGVVTAVERRGESLLEVTCRLQGDWSHRAGQFAFLTCDRLEGAHPFTIASADRGCGEVRFSIKALGDYTRRLQDNLEVGARVEVEGPYGCFDFRRGLAGRQVWVAAGIGVTPFIAWLESLQAAPESAPSVELHYCVRNSQEALFAGRLRELCEHLPSVTLHIRYSDDQGKPQAAQLGVLKSAEGRWPSVWFCGPQGLADSLRRDLRRQGMPLRLFHQEAFRMR

SEQ ID NO: 96 - protein, 434 aa, Pseudomonas aeruginosa PAK
MKLLWGVLAAALAAWGLTLAVDPPASLDIWVVRKQAILLTGVASFALMSLIMLLAVRPVWLEKPLDGLDRMYRLHKWAGILAIVLGLLHYLLELAGPWLAGIVGKPVKGPRVETFLDVFRGSAKELGEWSAWILGGMLLITLWQRFPYHLWRYVHKALALVYLVLAFHSVVLAPASYWSQPAGWLVAACALLGSACALLSLSGRIGRARRHAGVVTAVERRGESLLEVTCRLQGDWSHRAGQFAFLTCDRLEGAHPFTIASADRGCGEVRFSIKALGDYTRRLQDNLEVGARVEVEGPYGCFDFRRGLAGRQVWVAAGIGVTPFIAWLESLQAAPESAPSVELHYCVRNSQEALFAGRLRELCEHLPSVTLHIRYSDEQGKPQAAQLGVLKSAEGRWPSVWFCGPQGLADSLRRDLRRQGMPLRLFHQEAFRMR

SEQ ID NO: 97 - protein, 434 aa, Pseudomonas aeruginosa BL09
MKLLWGVLAAALAAWGLTLAVDPPASLDIWVVRKQAILLTGVASFALMSLIMLLAVRPVWLEKPLDGLDRMYRLHKWAGILAIVLGLLHYLLELAGPWLAGIVGKPVKGPRVETFLDVFRGSAKELGEWSAWILGGMLLITLWQRFPYHLWRYVHKALALVYLVLAFHSVVLAPASYWSQPAGWLVAACALLGSACALLSLSGRIGRARRHAGVVTAVERRGESLLEVTCRLQGDWSHRAGQFAFLTCDRLEGAHPFTIASADRGCGEVRFSIKALGDYTRRLQDNLEVGARVEVEGPYGCFDFRRGLAGRQVWVAAGIGVTPFIAWLESLQAAPESAPSVELHYCVRNSQEALFAGRLRELCERLPSVTLHIRYSDDQGKPQAAQLGVLKSAEGRWPSVWFCGPQGLADSLRRDLRRQGMPLRLFHQEAFRMR

SEQ ID NO: 98 - protein, 434 aa, Pseudomonas aeruginosa C23
MKLLWGVLAAALAAWGLTLAVDPPASLDIWVVRKQAILLTGVASFALMSLIMLLAVRPVWLEKPLDGLDRMYRLHKWAGILAIVLGLLHYLLELAGPWLAGIVGKPVKGPRVETFLDVFRGSAKELGEWSAWILGGMLLITLWQRFPYHLWRYVHKALALVYLVLAFHSVVLAPASYWSQPAGWLVAACALLGSACALLSLSGRIGRARRHAGVVTAVERRGESLLEVTCRLQGDWSHRAGQFAFLTCDRLEGAHPFTIASADRGCGEVRFSIKALGDYTRRLQDNLEVGARVEVEGPYGCFDFRRGLAGRQVWVAAGIGVTPFIAWLESLQAAPESAPSVELHYCVRNSQEALFAGRLRELCERLPSVTLHIRYSDEQGKPQAAQLGVLKSAEGRWPSVWFCGPQGLADSLRRDLRRQGMPLRLFHQEAFRMR

SEQ ID NO: 99 - protein, 434 aa, Pseudomonas aeruginosa NCMG1179
MKLLWGVLAAALAAWGLTLAVDPPASLDIWVVRKQAILLTGVASFALMSLIMLLAVRPVWLEKPLDGLDRMYRLHKWAGILAIVLGLLHYLLELAGPWLAGIVGKPVKGPRVETFLDVFRGSAKELGEWSAWILGGMLLITLWQRFPYHLWRYVHKALALVYLVLAFHSVVLAPASYWSQPAGWLVAACALLGSACALLSLSGRIGRARRHAGVVTAVERRGESLLEVTCRLQGDWSHRAGQFAFLTCDRLEGAHPFTIASADRGCGEVRFSIKALGDYTRRLQDNLEVGARVEVEGPYGCFDFRRGLAGRQVWVAAGIGVTPFIAWLESLQAAPGSAPSVELHYCVRNSQEALFAGRLRELCEHLPSVTLHIRYSDEQGKPKAAQLGVLKSAEGRWPSVWFCGPQGLADSLRRDLRRQGMPLRLFHQEAFRMR

SEQ ID NO: 100 - protein, 434 aa, Pseudomonas aeruginosa BL15
MKLLWGVLAAALAAWGLTLAVDPPASLDIWVVRKQAILLTGVASFALMSLIMLLAVRPVWLEKPLDGLDRMYRLHKWAGILAIVLGLLHYLLELAGPWLAGIVGKPVKGPRVETFLDVFRGSAKELGEWSAWILGGMLLITLWQRFPYHLWRYVHKALALVYLVLAFHSVVLAPASYWSQPAGWLVAACALLGSACALLSLSGRIGRARRHAGVVTAVERRGESLLEVTCRLQGDWSHRAGQFAFLTCDRLEGAHPFTIASADRGCGEVRFSIKALGDYTRRLQDNLEVGARVEVEGPYGCFDFRRGLAGRQVWVAAGIGVTPFIAWLESLQAVPESAPSVELHYCVRNSQEALFAGRLRELCEHLPSVTLHIRYSDEQGKPQAAQLGVLKSAEGRWPSVWFCGPQGLADSLRRDLRRQGMPLRLFHQEAFRMR

SEQ ID NO: 101 - protein, 434 aa, Pseudomonas aeruginosa CI27
MKLLWGVLAAALAAWGLTLAVDPPASLDIWVVRKQAILLTGVASFALMSLIMLLAVRPVWLEKPLDGLDRMYRLHKWAGILAIVLGLLHYLLELAGPWLAGIVGKPVKGPRVETFLDVFRGSAKELGEWSAWILGGMLLITLWQRFPYHLWRYVHKALALVYLVLAFHSVVLAPASYWSQPAGWLVAACALLGSACALLSLSGRIGRARRHAGVVTAVERRGESLLEVTCRLQGDWSHRAGQFAFLTCDRLEGAHPFTIASADRGCGEVRFSIKVLGDYTRRLQDNLEVGARVEVEGPYGCFDFRRGLAGRQVWVAAGIGVTPFIAWLESLQAVPESAPSVELHYCVRNSQEALFAGRLRELCEHLPSVTLHIRYSDEQGKPQAAQLGVLKSAEGRWPSVWFCGPQGLADSLRRDLRRQGMPLRLFHQEAFRMR

SEQ ID NO: 102 - protein, 434 aa, Pseudomonas aeruginosa 19660
MKLLWGVLAAALAAWGLTLAVDPPASLDIWVVRKQAILLTGVASFALMSLIMLLAVRPVWLEKPLDGLDRMYRLHKWAGILAIVLGLLHYLLELAGPWLAGIVGKPVKGPRVETFLDVFRGSAKELGEWSAWILGGMLLITLWQRFPYHLWRYVHKALALVYLVLAFHSVVLAPASYWSQPAGWLVAACALLGSACALLSLSGRIGRTRRHAGVVIAVERRGESLLEVTCRLQGDWSHRAGQFAFLTCDRLEGAHPFTIASADRGCGEVRFSIKALGDYTRRLQDNLEVGARVEVEGPYGCFDFRRGLAGRQVWVAAGIGVTPFIAWLESLQAAPESAPSVELHYCVRNSQEALFAGRLRELCERLPSVTLHIRYSDEQGKPQAAQLGVLKSAEGRWPSVWFCGPQGLADSLRRDLRRQGMPLRLFHQEAFRMR

SEQ ID NO: 103 - protein, 434 aa, Pseudomonas aeruginosa E2
MKLLWGVLAAALAAWGLTLAVDPPASLDIWVVRKQAILLTGVASFALMSLIMLLAVRPVWLEKPLDGLDRMYRLHKWAGILAIVLGLLHYLLELAGPWLAGIVGKPVKGPRVETFLDVFRGSAKELGEWSAWILGGMLLITLWQRFPYHLWRYVHKALALVYLVLAFHSVVLAPASYWSQPAGWLVAACALLGSACALLSLSGRIGRTRRHAGVVTAVERHGESLLEVTCRLQGDWSHRAGQFAFLTCDRLEGAHPFTIASADRGCGEVRFSIKALGDYTRRLQDNLEVGARVEVEGPYGCFDFRRGLAGRQVWVAAGIGVTPFIAWLESLQAAPESAPSVELHYCVRNSQEALFAGRLRELCEHLPSVTLHIRYSDEQGKPQAAQLGVLKSAEGRWPSVWFCGPQGLADSLRRDLRRQGMPLRLFHQEAFRMR

SEQ ID NO: 104 - protein, 434 aa, Pseudomonas aeruginosa C40
MKLLWGVLAAALAAWGLTLAVDPPASLDIWVVRKQAILLTGVASFALMSLIMLLAVRPVWLEKPLDGLDRMYRLHKWAGILAIVLGLLHYLLELAGPWLAGIVGKPVKGPRVETFLDVFRGSAKELGEWSAWILGGMLLITLWQRFPYHLWRYVHKALALVYLVLAFHSVVLAPASYWSQPAGWLVAACALLGSACALLSLSGRIGRTRRHAGVVTAVERHGESLLEVTCRLQGDWSHRAGQFAFLTCDRLEGAHPFTIASADRGCGEVRFSIKALGDYTRRLQDNLEVGARVEVEGPYGCFDFRRGLAGRQVWVAAGIGVTPFIAWLESLQAAPESAPSVELHYCVRNSQEALFAGRLRELCERLPSVTLHIRYSDEQGKPQAAQLGVLKSAEGRWPSVWFCGPQGLADSLRRDLRRQGMPLRLFHQEAFRMR

SEQ ID NO: 105 - protein, 434 aa, Pseudomonas aeruginosa 62
MKLLWGVLAAALAAWGLTLAVDPPASLDIWVVRKQAILLTGVASFALMSLIMLLAVRPVWLEKPLDGLDRMYRLHKWAGILAIVLGLLHYLLELAGPWLAGIVGKPVKGPRVETFLDVFRGSAKELGEWSAWILGGMLLITLWQRFPYHLWRYVHKALALVYLVLAFHSVVLAPASYWSQPAGWLVAACALLGSACALLSLSGRIGRTRRHAGVVTAVERHGESLLEVTCRLQGDWSHRAGQFAFLTCDRLEGAHPFTIASADRGCGEVRFSIKALGDYTRRLQDNLEVGARVEVEGPYGCFDFRRGLAGRQVWVAAGIGVTPFIAWLESLQAVPESAPSVELHYCVRNSQEALFAGRLRELCEHLPSVTLHIRYSDEQGKPKAAQLGVLKSAEGRWPSVWFCGPQGLADSLRRDLRRQGMPLRLFHQEAFRMR

SEQ ID NO: 106 - protein, 434 aa, Pseudomonas aeruginosa MSH-10
MKLLWGVLAAALAAWGLTLAVDPPASLDIWVVRKQAILLTGVASFALMSLIMLLAVRPVWLEKPLDGLDRMYRLHKWAGILAIVLGLLHYLLELAGPWLAGIVGKPVKGPRVETFLDVFRGSAKELGEWSAWILGGMLLITLWQRFPYHLWRYVHKALALVYLVLAFHSVVLAPASYWSQPAGWLVAACALLGSACALLSLSGRIGRTRRHAGVVTAVERHGESLLEVTCRLQGDWSHRAGQFAFLTCDRLEGAHPFTIASADRGCGEVRFSIKALGDYTRRLQDNLEVGARVEVEGPYGCFDFRRGLAGRQVWVAAGIGVTPFIAWLESLQAVPESAPSVELHYCVRNSQEALFAGRLRELCEHLPSVTLHIRYSDEQGKPQAAQLGVLKSAEGRWPSVWFCGPQGLADSLRRDLRRQGMPLRLFHQEAFRMR

SEQ ID NO: 107 - protein, 434 aa, Pseudomonas aeruginosa BWHPSA022
MKLLWGVLAAALAAWGLTLAVDPPASLDIWVVRKQAILLTGVASFALMSLIMLLAVRPVWLEKPLDGLDRMYRLHKWAGILAIVLGLLHYLLELAGPWLAGIVGKPVKGPRVETFLDVFRGSAKELGEWSAWILGGMLLITLWQRFPYHLWRYVHKALALVYLVLAFHSVVLAPASYWSQPAGWLVAACALLGSACALLSLSGRIGRTRRHAGVVTAVERYGESLLEVTCRLQGDWSHRAGQFAFLTCDRLEGAHPFTIASADRGCGEVRFSIKALGDYTRRLQDNLEVGARVEVEGPYGCFDFRRGLAGRQVWVAAGIGVTPFIAWLESLQAVPESAPSVELHYCVRNSQEALFAGRLRELCEHLPSVTLHIRYSDEQGKPKAAQLGVLKSAEGRWPSVWFCGPQGLADSLRRDLRRQGMPLRLFHQEAFRMR

SEQ ID NO: 108 - protein, 434 aa, Pseudomonas aeruginosa C48
MKLLWGVLAAALAAWGLTLAVDPPASLDIWVVRKQAILLTGVASFALMSLIMLLAVRPVWLEKPLDGLDRMYRLHKWAGILAIVLGLLHYLLELAGPWLAGIVGKPVKGPRVETFLDVFRGSAKELGEWSAWILGGMLLITLWQRFPYHLWRYVHKALALVYLVLAFHSVVLAPASYWSQPAGWLVAACALLGSACALLSLSGRIGRTRRHAGVVTAVERYGESLLEVTCRLQGDWSHRAGQFAFLTCDRLEGAHPFTIASADRGCGEVRFSIKALGDYTRRLQDNLEVGARVEVEGPYGCFDFRRGLAGRQVWVAAGIGVTPFIAWLESLQAVPESAPSVELHYCVRNSQEALFAGRLRELCEHLPSVTLHIRYSDEQGKPQAAQLGVLKSAEGRWPSVWFCGPQGLADSLRRDLRRQGMPLRLFHQEAFRMR

SEQ ID NO: 109 - protein, 434 aa, Pseudomonas aeruginosa BL13
MKLLWGVLAAALAAWGLTLAVDPPASLDIWVVRKQAILLTGVASFALMSLIMLLAVRPVWLEKPLDGLDRMYRLHKWAGILAIVLGLLHYLLELAGPWLAGIVGKPVKGPRVETFLDVFRGSAKELGEWSAWILGGMLLITLWQRFPYHLWRYVHKALSLVYLVLAFHSVVLAPASYWSQPAGWLVAACALLGSACALLSLSGRIGRARRHAGVVTAVERHGESLLEVTCRLQGDWSHRAGQFAFLTCDRLEGAHPFTIASADRGCGEVRFSIKALGDYTRRLQDNLEVGARVEVEGPYGCFDFRRGLAGRQVWVAAGIGVTPFIAWLESLQAAPGSAPSVELHYCVRNSQEALFAGRLRELCEHLPSVTLHIRYSDEQGKPQAAQLGVLKSAEGRWPSVWFCGPQGLADSLRRDLRRQGMPLRLFHQEAFRMR

SEQ ID NO: 110 - protein, 434 aa, Pseudomonas aeruginosa BWHPSA018
MKLLWGVLAAALAAWGLTLAVDPPASLDIWVVRKQAILLTGVASFALMSLIMLLAVRPVWLEKPLDGLDRMYRLHKWAGILAIVLGLLHYLLELAGPWLAGIVGKPVKGPRVETFLDVFRGSAKELGEWSAWILGGMLLVTLWQRFPYHLWRYVHKALALVYLVLAFHSVVLAPASYWSQPAGWLVAACALLGSACALLSLSGRIGRTRRHASVVTAVERHGESLLEVTCRLQGDWSHRAGQFAFLTCDRLEGAHPFTIASADRGCGEVRFSIKALGDYTRRLQDNLEVGARVEVEGPYGCFDFRRGLAGRQVWVAAGIGVTPFIAWLESLQAVPESAPSVELHYCVRNSQEALFAGRLRELCEHLPSVTLHIRYSDEQGKPQAAQLGVLKSAEGRWPSVWFCGPQGLADSLRRDLRRQGVPLRLFHQEAFRMR

SEQ ID NO: 111 - protein, 434 aa, Pseudomonas aeruginosa CIG1
MKLLWGVLAAALAAWGLTLAVDPPASLDIWVVRKQAILLTGVASFALMSLIMLLAVRPVWLEKPLDGLDRMYRLHKWAGILTIVLGLLHYLLELAGPWLAGIVGKPVKGPRVETFLDVFRGSAKELGEWSAWILGGMLLVTLWQRFPYHLWRYVHKALALVYLVLAFHSVVLAPASYWSQPAGWLVAACALLGSACALLSLSGRIGRTRRHAGVVTAVERHGESLLEVTCRLQGDWSHRAGQFAFLTCDRLEGAHPFTIASADRGCGEVRFSIKALGDYTRRLQDNLEVGARVEVEGPYGCFDFRRGLAGRQVWVAAGIGVTPFIAWLESLQAAPESAPSVELHYCVRNSQEALFAGRLRELCEHLPSVTLHIRYSDEQGKPQAAQLGVLKSAEGRWPSVWFCGPQGLADSLRRDLRRQGMPLRLFHQEAFRMR

SEQ ID NO: 112 - protein, 434 aa, Pseudomonas aeruginosa c7447m
MKLLWGVLAAALAAWGLTLAVDPPASLDIWVVRKQAILLTGVASFALMTLIMLLAVRPVWLEKPLDGLDRMYRLHKWAGILAIVLGLLHYLLELAGPWLAGIVGKPVKGPRVETFLDVFRGSAKELGEWSAWILGGMLLITLWQRFPYHLWRYVHKALALVYLVLAFHSVVLAPASYWSQPAGWLVAACALLGSACALLSLSGRIGRTRRHAGVVTAVERHGESLLEVTCRLQGDWSHRAGQFAFLTCDRLEGAHPFTIASADRGCGEVRFSIKALGDYTRRLQDNLEVGARVEVEGPYGCFDFRRGLAGRQVWVAAGIGVTPFIAWLESLQAAPESAPSVELHYCVRNSQEALFAGRLRELCEHLPSVTLHIRYSDEQGKPQAAQLGVLKSAEGRWPSVWFCGPQGLADSLRRDLRRQGMPLRLFHQEAFRMR

SEQ ID NO: 113 - protein, 434 aa, Pseudomonas aeruginosa CF614
MKLLWGVLAAALAAWGLTLAVDPPASLDIWVVRKQAILLTGVASFALMTLIMLLAVRPVWLEKPLDGLDRMYRLHKWAGILAIVLGLLHYLLELAGPWLAGIVGKPVKGPRVETFLDVFRGSAKELGEWSAWILGGMLLVTLWQRFPYHLWRYVHKALALVYLVLAFHSVVLAPASYWSQPAGWLVAACALLGSACALLSLSGRIGRTRRHAGVVTAVERHGESLLEVTCRLQGDWSHRAGQFAFLTCDRLEGAHPFTIASADRGCGEVRFSIKALGDYTRRLQDNLEVGARVEVEGPYGCFDFRRGLAGRQVWVAAGIGVTPFIAWLESLQAAPESAPSVELHYCVRNSQEALFAGRLRELCEHLPSVTLHIRYSDEQGKPQAAQLGVLKSAEGRWPSVWFCGPQGLADSLRRDLRRQGMPLRLFHQEAFRMR

SEQ ID NO: 114 - protein, 434 aa, Pseudomonas aeruginosa BWHPSA025
MKLLWGVLAAALAAWGLTLAVDPPASLDIWVVRKQAILLTGVVSFALMTLIMLLAVRPVWLEKPLDGLDRMYRLHKWAGILAIVLGLLHYLLELAGPWLAGIVGKPVKGPRVETFLDVFRGSAKELGEWSAWILGGMLLVTLWQRFPYHLWRYVHKALALVYLVLAFHSVVLAPASYWSQPAGWLVAACALLGSACALLSLSGRIGRTRRHAGVVTAVERHGESLLEVTCRLQGDWSHRAGQFAFLTCDRLEGAHPFTIASADLGCGEVRFSIKALGDYTRRLQDNLEVGARVEVEGPYGCFDFRRGLAGRQVWVAAGIGVTPFIAWLESLQAAPESAPSVELHYCVRNSQEALFAGRLRELCEHLPSVTLHIRYSDEQGKPQAAQLGVLKNAEGRWPSVWFCGPQGLADSLRRDLRRQGMPLRLFHQEAFRMR

SEQ ID NO: 115 - protein, 434 aa, Pseudomonas aeruginosa VRFPA02
MKLLWGVLAAALAAWGLTLAVDPPASLDIWVVRKQAILLTGVVSFALMTLIMLLAVRPVWLEKPLDGLDRMYRLHKWAGILAIVLGLLHYLLELAGPWLAGIVGKPVKGPRVETFLDVFRGSAKELGEWSAWILGGMLLVTLWQRFPYHLWRYVHKALALVYLVLAFHSVVLAPASYWSQPAGWLVAACALLGSACALLSLSGRIGRTRRHAGVVTAVERHGESLLEVTCRLQGDWSHRAGQFAFLTCDRLEGAHPFTIASADRGCGEVRFSIKALGDYTRRLQDNLEVGARVEVEGPYGCFDFRRGLAGRQVWVAAGIGVTPFIAWLESLQAAPESAPSVELHYCVRNSQEALFAGRLRELCEHLPSVTLHIRYSDEQGKPQAAQLGVLKSAEGRWPSVWFCGPQGLADSLRRDLRRQGMPLRLFHQEAFRMR

SEQ ID NO: 116 - protein, 434 aa, Pseudomonas aeruginosa C3719
MKLLWGVLAAALAAWGLTLAVDPPASLDIWVVRKQAILLTGVVSFALMTLIMLLAVRPVWLEKPLDGLDRMYRLHKWAGILAIVLGLLHYLLELAGPWLAGIVGKPVKGPRVETFLDVFRGSAKELGEWSAWILGGMLLVTLWQRFPYHLWRYVHKALALVYLVLAFHSVVLAPASYWSQPAGWLVAACALLGSACALLSLSGRIGRTRRHAGVVTAVERHGESLLEVTCRLQGDWSHRAGQFAFLTCDRLEGAHPFTIASADRGCGEVRFSIKALGDYTRRLQDNLEVGARVEVEGPYGCFDFRRGLAGRQVWVAAGIGVTPFIAWLESLQAAPESAPSVELHYCVRNSQEALFAGRLRELCEHLPSVTLHIRYSDEQGKPQAAQLGVLKSAEGRWPSVWFCGPQGLADSLRRDLRRQGVPLRLFHQEAFRMR

SEQ ID NO: 117 - protein, 434 aa, Pseudomonas aeruginosa BL01
MKLLWGVLAAALAAWGLTLAVDPPASLDIWVVRKQAILLTGVVSFALMTLIMLLAVRPVWLEKPLDGLDRMYRLHKWAGILAIVLGLLHYLLELAGPWLAGIVGKPVKGPRVETFLDVFRGSAKELGEWSAWILGGMLLVTLWQRFPYHLWRYVHKALALVYLVLAFHSVVLAPASYWSQPAGWLVAACALLGSACALLSLSGRIGRTRRHAGVVTAVERHGESLLEVTCRLQGDWSHRAGQFAFLTCDRLEGAHPFTIASADRGCGEVRFSIKALGDYTRRLQDNLEVGARVEVEGPYGCFDFRRGLAGRQVWVAAGIGVTPFIAWLESLQAVPESAPSVELHYCVRNSQEALFAGRLRELCEHLPSVTLHIRYSDEQGKPQAAQLGVLKSAEGRWPSVWFCGPQGLADSLRRDLRRQGVPLRLFHQEAFRMR

SEQ ID NO: 118 - protein, 446 aa, Thauera phenylacetica B4P
MKNIKFALLLVLAALSLLWWWADPLLIQGDTYFALRMLAVNYTGVLAMGTMSVAMILALRPAALEPLLGGMDKAYRLHKWLGIAGLSIGVVHWLWAKGTKWAVGWGWLEKPARGARPEQTVELFRFFQEQRGLAESIGEWAFYLFAVLAAIALIKRFPYRRFVQTHRVMAAVYLALVVHGVVLLPFAYWTEPAGIVMAVLMAAGSWAALRSLAGRIGSGRRAHGHIERVVQHRDNQVLEVGLRLDTPWPGHQAGQFAFVTFDEREGPHPFTISSAWGDDGRMDFMIKPLGDYTRRLPATLKAGDPVRVEGPYGRFDFGGAQARQIWVAGGIGITPFVARMQARAQDETHADGAAPVDLFYSTSAPDEGFIARLRELAAQARVKLHVLVSQRDGRLDADGICRKVPDWKLAGVWFCGPAGFGATLRDTLAARGLPTERFHQELFEMR

SEQ ID NO: 119 - protein, 424 aa, Neisseria sicca ATCC 29256
MKNIKFTLAIFFGGIFALWLLATSFPDQWGVFPARNLLLQLTGTISILLILAVRPKMLETPLGGLDKMYRLHKWFGIIALSGSILHWTSKQFPKWLVKLGLFDGKKPPRPPMQEILTLKDWLTTQRHFAEEVGEIAFYVALVLLIAALIKRIPYRWFAKLHILIVPVYLALVWHTIVLANFAYWSQPLGWLLIAALLAGIACSLIALFKRIGNPQNATVSSLNQNGNLLSLTLNAPKWQGHRAGQFLFLREHGESHPFTIASDWQPNHQQLTLIIKSLGDYTRRLPQGLNVGDTVQIDGAYGRFDFSDGQAQIWVSNGIGFTPFLARLNELAKQPATQPTDWFHADRNLPAETLAHWQNLAQQANVNFHYIPSETQRLTAEHIGQTVRDSANRSLWLCGNRNFTRSISGSLKTRSQHLELFEFR

SEQ ID NO: 120 - protein, 429 aa, Neisseria sicca VK64
MKNIKFTLAIFFGGIFALWLLATSFPDQWGVFPVRNLLLQLTGTISILAMSACLILAVRPKILETPLGGLDKMYRLHKWLGIIAFSGSILHWTCKQFPKWLIALGLIDGKKPPRPPMQEILTLKDWLATQRHFAEEVGEIAFYVALVLLIAALIKRIPYRWFAKLHILIVPVYLALVWHAIVLANFAYWSQPLGWLLIAALLSGIACSLIALFKRIGNPQNATVSSLNQNGNLLSLTLNAPKWQGHRAGQFLFLRAHGESHPFTIASDWQPDNQQLTLVIKDLGDYTRRLPQRLNIGDTVQIDGAYGRFDFSDGQAQIWVSNGIGFTPFLARLNELAKQPATQPTDWFHADRNLPAETLAHWQNLAQQANVNFHYIPSETQRLTAEHISQTVRDSTNRSLWLCGSRSFTRSISGSLKTRSQHLEFFEFR

SEQ ID NO: 121 - protein, 429 aa, Neisseria sp. GT4A_CT1
MKNIKFTLAIFFGGIFALWLLATSFPDQWGVFPVRNLLLQLTGTISILAMSACLILAVRPKILETPLGGLDKMYRLHKWLGIIALSGSILHWTCKQFPKWLIELGLIDGKRPPRPPMQEILTLKDWLATQRHFAEEVGEIAFYVALVLLVAALIKRIPYRWFAKLHILIVPVYLALVWHTIVLANFAYWSQPLGWLLIAALLAGIACSLIALFKRIGNPQNATVSSLNQNGNLLSLTLNAPKWQGHRAGQFLFLRAHGESHPFTIASDWQPDNQQLTLVIKDLGDYTRRLPQRLNIGDTVQIDGAYGRFDFSDGQAQIWVSNGIGFTPFLARLNELAKQPATQPTDWFHADRNLPAETLAHWQNLAQQANVNFHYIPSETQRLSAEHIGQTVRDSANRSLWLCGSRNFTRSISGSLKTRSQHLEFFEFR

SEQ ID NO: 122 - protein, 429 aa, Neisseria macacae ATCC 33926
MKNIKFTLAIFFGGIFALWLLATSFPDQWGVFPVRNLLLQPTGTISILAMSGCLILAVRPKILETPLGGLDKMYRLHKWLGIIALSGSILHWTCKQFPKWLVKLGLFDGKKPPRPPMQEILTLKDWLATQRHFAEEVGEIAFYVALVLLVAALIKRIPYRWFAKLHILIVPVYLALVWHTIVLANFSYWSQPLGWLLIAAMLAGIACSLIALFKRIGKPQNATVSALNQNGNLLSLTLNAPKWQGHRAGQFLFLRAHGESHPFTIASDWQPDNQQLTLVIKDLGDYTRRLPQRLNIGDTVQIDGAYGRFDFSDGQAQIWVSNGIGFTPFLARLNELAKQPATQPIDWFHADRNLPAETLAHWQNLAQQANVNFHYIPSETQRLSAEHIGQTVRDSANRSLWLCGNRNFTRSISGSLKTRSQHLELFEFR

SEQ ID NO: 123 - protein, 429 aa, Neisseria subflava NJ9703
MKNIKFTLFAFLVGISALWLFATPFPDKWGVFPVRNLLLQFTGSISILAMSACMILAVRPKMLEGLFGGLDKMYRLHKWLGIIALSGSILHWISKQFPKWLVKLGLFDGKKPPRPPMQEVLTLKDWLVTQRHFAEEVGEIAFYVAVVLLVIALIKLIPYRWFAKLHILIVPVYIALVWHTIVLANFAYWAQPLGWLLATALFFGSICSLLALFKRIGKPQTATVTAMNQNGSLLSLTLNAPKWQGHQAGQFLFLRAHGESHPFTIASNWNPENQQINLIIKDLGDYTHRLSQRLNIGDTVKIDGAYGRFNFSDKNEQIWVSNGIGFTPFLARLKELAKQPSNQQIDWFHADRNLSAEIINQWKDLAQQANVTFHYIPSETQRLSADHIVQSVQNSETRSLWLCGSRSFTNSIAGKLKTRSLHQELFEFR

SEQ ID NO: 124 - protein, 442 aa, Azoarcus sp. BH72
MKNIKLAFLVPPVVLTLLWLAADPVLWGEIRFFPLRAALMNYTGILGIAAMSVGVMLAARPAWADARLGGLDKGYRLHKWLGIAGLVIATLHWALAKLPKWMVGWGWLERPLRGPRAEQSVAIFRFFQEQRGLAETVGEWAFHAALVLIALALIKRFPYRRFVRTHHLLAVVYLALVFHAVVLMKFSYWSEPLGPLMALLMAGGTLAALASLFRRVGRSRQVSGEIEELVRHPDNGVLRVGVRLRGRWPGHQAGQFAFVSFDATEGPHPFTICSAWTGDGRLVFMIKGLGDYTARLPDTLKVGDPVRVEGPYGRFDFAGARPRQVWVAGGIGITPFVARLQALAGQHDGRPVDLFYSTAAPDEGFIARLRQHAERAGVALHVQVTPIQGRLDAGRIRAEVPAWKEADFWFCGPAAFGNTLRAELTAGGLGAGDFHQELFEMR

SEQ ID NO: 125 - protein, 441 aa, Thauera terpenica 58Eu
MKNIKLALALILATLSLLWWLADPLLIEGNTFFAIRALAVHYSGVLAIGAMSVAMILALRPTAVEPLLGGMDKTYRLHKWLGIAGLSVATVHWLWAKGTKWAVGWGWLERPHRGPRPEQTVELFRFFQEQRGLAETIGEWAFYAFAVVAAIALIKRFPYRRFVQTHRLMAALYLALVVHSVVLLPFTYWSTPLGLVMGVLMAAGSYAALQSLRGRIGRGRRAHGIVERIVQYPDNQVLEVSLRLATPWPGHQAGQFAFVTFDEDEGPHPFTISSAWTDDGRMRFMIKPLGDYTRRLPESLKTGDPVRIEGPYGRFDFGGQEHQIWVAGGIGITPFVARMQARLHEGEDAPVDLFYSTRAPDEGFIKQLRELAAQAQVKLHVLISGRNARLDADGICQAVPNWKSAGIWFCGPAAFGDTLRATLGARGLDSRRFHQELFDMR

SEQ ID NO: 126 - protein, 446 aa, Thauera sp. MZ1T
MKNIKLALLLVLATLSLLWWWADPLLVQGDTYFALRTLAVNYTGVLAMGAMSIAMILALRPAALEPLLGGMDKAYRLHKWLGIAGLSVGVVHWLWAKGTKWAVGWGWLQKPARGPRPEQTVELFRFFQEQRGLAETIGEWAFYLFAVLAAIALIKRFPYRRFVQTHRVMAAVYLALVVHGVVLLPFAYWTQPLGMVMGMLMAAGSWAALRSLAGRIGRGRRAHGRIERVVRHPANQVLEVGLRLDTPWPGHQAGQFAFVTFDEREGPHPFTISSAWGGDGRMDFMIKPLGDYTRSLPATLKLGDPVRVEGPYGRFDFGGAQARQIWVAGGIGITPFVARMQARAQEDRPGGRAAAIDLFYSTSAPDEGFIARLRELAARARVQLHVLVSPRDGRLDADGICRSVPDWKQAGVWFCGPAGFGAMLRDTLAARGLPAERFHQELFEMR

SEQ ID NO: 127 - protein, 446 aa, Thauera phenylacetica B4P
MKNIRFAYAALLLLLSLLWWMADPLLPNGYEYFALRTVAINYTGVIGIGVMSVGMILALRPVRVEPLLDGLDKTYRLHKWLGITGLVFAVIHWLWAQGTKWAVGWGWLVKPERGPKPTLTDPVESFFRAQRGLAESVGEWAFYAAVVLIVIALAKRFPYRLFFKTHRLLALAYLALVFHSVLLTPFAYWAQPMGIVLAVLMAGGSVAAVVSLSGRVGHRRKAVGEIEELVPFPDNRVLKVAIRFKDRWPGHEAGQFAFVTFSTDEGAHPFTISSGWQGDGRLFFLIKGIGDYTARLRELLRVGDLVTVEGPYGRFDFASGSVGGKRRQIWVGGGIGITPFIARMKALAVAPDGREVDLFYSTAEPDQEFIARLQRDAQAAGVRLYVLVSARDGRLDVARICDTVPGWAEADVWFCGPGRFGQALREGFVARGLPAADFHQELFDMR

SEQ ID NO: 128 - protein, 446 aa, Thauera aminoaromatica S2
MKNIRFAYAGLLLLLSLLWWMADPLLPAGYEYFALRTVAINYTGVIGIGVMSVGMILALRPVRVEPLLDGLDKTYRLHKWLGITGLVFSVIHWLWAQGTKWAVGWGWLVKPERGPKPPLTDPVESFFRAQRGLAESVGEWAFYAAVVLIVIALAKRFPYRLFFKTHRLLALAYLALVFHSVLLTPFAYWTQPMGIVLAVLMAGGSVAAVVSLSGRVGHRRKAVGEIEELVPFPDNRVLKVAIRFKDRWPGHEAGQFAFVTFSRDEGAHPFTISSGWKEDGRLFFLIKGIGDYTARLPELLRVGDLVTVEGPYGRFDFASGSASGKRRQIWVGGGIGITPFIARMKALAVEPDGREVDLFYSTAEPDQGFIARLQRDAQAAGVRLHVLVSARDGRLDVARICDTVPGWAEADVWFCGPGGFGQSLREGFVARGLPAADFHQELFDMR

SEQ ID NO: 129 - protein, 446 aa, Thauera sp. MZ1T
MKNIRFAYAGLLLLLSLLWWMADPLLPAGYEYFALRTVAINYTGVIGIGVMSVGMILALRPVRVEPLLDGLDKTYRLHKWLGITGLVFSVIHWLWAQGTKWAVGWGWLVKPERGPKPPLTDPVESFFRAQRGLAESVGEWAFYAAVVLIVIALAKRFPYRLFFKTHRLLALAYLALVFHSVLLTPFAYWTQPMGIVLAVLMAGGSVAAVVSLSGRVGHRRKAVGEIEELVPFPDNRVLKVAIRFKDRWPGHEAGQFAFVTFSRDEGAHPFTISSGWKEDGRLFFLIKGIGDYTARLPELLRVGDLVTVEGPYGRFDFASGSTSGKRRQIWVGGGIGITPFIARMKALAVEPDGREVDLFYSTAEPDQGFIARLQRDAQAAGVRLHVLVSARDGRLDVARICDTVPGWAEADVWFCGPGGFGQSLREGFVARGLPAADFHQELFDMR

SEQ ID NO: 130 - protein, 443 aa, Azotobacter vinelandii ATCC BAA-1303
MKNIRIAYLVLFVGLGLLWLLADERLGAPYEFFALRRSLVNLTGILAVGAMSLGVFLATRPAFLESFLGGLDKGYRLHKWLGISALVMAIVHWLWVKAPKWMVGWGWLERPARKASGGEEVGALLGFLRSQRGLAEQLGEWAFYAVVVLILLALFKRFPYRHFFKTHRLLAIVYLVLVFHTVVLMDSAYWISPLGVAMAALLLAGSTAAGVSLLRRIGGSRRALGHIEALELHRDNRVLGIDIRLQDRWPGHRAGQFAFVTFDPAEGPHPFTISSAWHDDGRLRFHVKGIGDYTATLPRMLEVGDPVGVEGPYGRFDFAGGKARQIWVAGGIGITPFIARLQALAKRPDGRGVDLFYSTAAPDQAFIERLRTLAERAGVRLHVLVSGHDERLTGERLRERVPDWRGADVWFCGPAGFGRSLRASLTGSGLPAADFHQELFEMR

SEQ ID NO: 131 - protein, 442 aa, Pseudomonas stutzeri DSM 10701
MKNIRLSFIILFIGLSLLWLLAEDFSLQGHGFWPLRTTMVHYSGILAMGAMSVAMLLAMRPVRIERFFDGLDKTYRLHKWLGISALVLSILHWGWARIPKWLVGWGWLERPARKGAAQSADTFYGYLHSLRGFAEGIGEWAFYAAALLLVLALSKRVPYRWFFKTHRLLALAYLVLVVHSSILLPPAYWESAIGPLMILLMLAASVAAGVSLTRRVGRRHQVVGRIDELHYHRDNHVLRVGIDLDGPWPGHLAGQFAFVTFDAQEGPHPFSVCSAWHNDGKLAFSIKGLGDYTRSLPERLRIGNPVTVEGPYGCFDFRGSKPQQIWIAGGIGIAPFIARLQALAPTRGGGNVTLFYSTSAPDRQFIERIRQLAAQARVQLHVLVTHQDGRLTPERMRQLAPQWKRCDIWFCGPAGFARDLRDDLQERGLPPEDFHQELFNMR

SEQ ID NO: 132 - protein, 421 aa, Clostridium saccharobutylicum DSM 13864
MKNKSGNIIILFSMIITWILWLFTKSTRDISSMSGYSQLIASFALVAFALVNFISTRHKILDYLFDGLDKSYIYHRYLSILALILVVIHNITISIGKHIEISQGIRIPKDPYAMYGAFSMYLFIILVSVAILGKKLNYERWKTIHKFMFIPYAFGIYHYYGSATYAVFAIEPFSIWLNIINLLGIISVVYSIFFYEKTSFKHVFKVKNLQRVANGTLEITGSSLKEDVKFKPGQFAFLKILDKENKFKSHPFTISQAPKKGELQFTIKALGDDTRVLFDTLKVGDKFEVSGPHGKFDYKTGTKNQIWIAGGIGVTPFRSFSEEGISKDFSIDFFYAYNNVEEGAYVDELLSLANDNLRVHLFNSKEKGFLSVQEICKYVNTQESIDIYFCGPKPMRESLRKQFENSNLNVNNFNYEHFQFK

SEQ ID NO: 133 - protein, 441 aa, Pseudomonas sp. Chol1
MKPIKLTFLGLFAGLTLLWLLVDSFLMEQYQIWAIRTVLVHYSGVLAIGAMSVAVILAARPKRFERFFDGLDKTYRLHKWLGIAALVISTMHWAWGQVPKWLVGAGWLEKPVRHAGPPPEGIFGLFRRFRGLAEDVGEWAFYAAAILIVLALIKTFPYRWFFKTHRWLAVAYLALVAHSVVLTPPDYWSSPLGLALALMMGAGSVAACISLLRRIGRKHKVVGRIDELTHHPDNRVLRVGLQLEGAWPGHEAGQFAFVTFDEKEGPHPFSLSSAWCNDGKLAFSIKGLGDYTSTLPHTLKVGDAVTVEGPYGCFDFRGRKDGQIWVAGGIGIAPFIGRLQALATTGGGGNVELFYSTSAPDQAFIDKVQQLAEQARVRLHVLVTQRDGRLTPERLRQLAPSWKGSDVWFCGPAAFGQCLRDDLIARGLAPQDFHQELFNMR

SEQ ID NO: 134 - protein, 441 aa, Pseudomonas stutzeri TS44
MKPIKLTFLGLFAGLTLLWLLVDSILMEQYQFWSIRTVLVHYSGVLAIGAMSVALVLAARPKRFERFFDGLDKTYRLHKWLGIAALAIGTFHWAWGQVPKWLVGAGWLEKPVRHAGPPPEGIFGLLRRFRGLAEDIGEWAFYATAILIVLALIKTFPYRWFFKTHRWLALIYLALVVHSVILTPPAYWTSPLGVTLALLMGAGSIAACISLLRRIGRKHKVVGYIEELTHHPDNRVLRVGLQLEGAWPGHQAGQFAFVTFDEKEGPHPFSLSSAWCNDGKLMFSIKGLGDYTSTLPHTLKRGNAVTVEGPYGCFDFRGRKDGQIWVAGGIGIAPFIGRLQALATTGGGGNVDLFYSTSAPDQAFIDKVQQLAEQARVRLHVLVSQRDGRLTPERLRQLAPSWKGSDLWFCGPAAFGQCLRDDLIARGLAPQDFHQELFNMR

SEQ ID NO: 135 - protein, 417 aa, Pseudomonas sp. CF161
MKPWHCILGILLITSITVLIEIPSSTWLTSASLSLILGASALVYMATSCLLASRWRWVERLFGGLDRVYEAHKWLGIWALVFASYHFVFKANLDLWNSVPIIELPKYWTRLVRQLSYVALGLIVLLALNRNIPYRLWRWWHKLSGPLFVIVILHWLSFKSPIALNTPSGLWLTLLCGLGLLGALYKLLLYPVLAKAGEYTVSAVSAHKHSLHLELTPVQQGFAFKAGQFAFLALKEKGLREPHPFTIASAHASDGRIEFVIRALGDYTQKLRDQVKVGMLADVYAPYGQFKRQVDAPREIWVAGGVGISPFISWLQDDASERLDNTTLVYCFNPSRAFPTAEQLQSMAEQRGVRFVGQDGGADQLSETFKHAVAQTDPQQIQISFCGPKSLLERVRELMREQAIPEANLHYELFEFR

SEQ ID NO: 136 - protein, 460 aa, Oleispira antarctica RB-8
MKQHKLSITLVLITVCIFTVWAWSYAMNTTATASLPWEIYNNGLYLSGLLSIALMSITMMLAIRPAWLETPFNGLDKVYRLHKWTGILAVVFAAFHWLIEMGDDVIKSLFGRDGRLPKEDFSGFIEMMRDAAEDVGEWTVYLIFAMLLLTLWKRFPYNIWRYVHRAMPILYLLLVFHAVFLAPLVWWQQPVGLLMALLLVGGSIASMVSLKGKIGQSRKVQGTICSISPQSISARSKIEPTNDIIEVECQLENKWKGHRAGQFVFVTFDRIEGAHPFTIASLDRGNGLVTFQIKALGDYTKRLDHKLSMGQSVTVEGPYGRFNFKPKKPNAVQVWIAGGIGVTPFLAKLEELQDTAMQASSEQANTKTQMHYSTSDSASDPFVKRLQDACLSLPEIQLHVHDSQEGEKLTAEQLLTQVSKKAALEVWFCGPTGWAKVLEHELREKSSGSLVFHKEAFELR

SEQ ID NO: 137 - protein, 431 aa, Bifidobacterium animalis subsp. lactis ATCC 27673
MKRIAIRRFPIQAVLVWAAALVVVPMPFTAIPWATLGPMYRSMLTPITAGIYAYIWMLECVWLGCRPRWLDRIIGLPGIYVLHGVLGTGALALLVYHQYVLPSFGPAKTTGEIAFWTLVGIVALALVMMAGWLDTLVPPLATVRSWLERVFRHEFTVWLHRIVLVAVVLACLHFNLVFYIKDLTAFIVTMDVTTGLVLAWYAWVKLRDRMFAARGKVVSARRVSNDIVEILVDCPAMHSWEYGDFVFLRLPRERGMHGSHPFSIANLPGEHGDAMRFAVRINGDFTERLYRTTRAGMRVDVIGPFGMYERFIARHDAHAPIVVYAGGVGITPIIPTIMALSGTNRPVTVMYTAKRADDLLYADELRKWSASEAHTPHMQVGRWSKAELAEQITDGAIYLIAGPSGMIRDVRRMLLRHGVPGSRMFYEPFTR

SEQ ID NO: 138 - protein, 431 aa, Bifidobacterium animalis subsp. lactis HN019
MKRIAIRRFPIQAVLVWAAALVVVPMPFTAIPWATLGPMYRSMLTPITAGIYAYIWMLECVWLGCRPRWLDRIIGLPGIYVLHGVLGTGALALVVYHQYVLPSFGPAKTTGEIAFWTLVGIVALALVMMAGWLDTLVPPLATVRSWLERVFRHEFTVWLHRIVLVAVVLACLHFNLVFYIKDLTAFIVTMDVTTGLVLAWYAWVKLRDRMFAARGKVVSARRVSNDIVEILVDCPAMHSWEYGDFVFLRLPRERGMHGSHPFSIANLPGEHGDAMRFAVRINGDFTERLYRTARAGMRVDVIGPFGMYERFIARHDAHAPIVVYAGGVGITPIIPTIMALSGTNRPVTVMYTAKRADDLLYADELRKWSASEAHTPHMQVGRWSKTELAEQITDGAIYLIAGPSGMIRDVRRMLLRHGVPGSRMFYEPFTR

SEQ ID NO: 139 - protein, 442 aa, Aromatoleum aromaticum EbN1
MKRIKFGLIFILVSLSLLWWQADPLLLQGDRFFAIRKLVVNYTGVLAMGVMSFAMVLALRPVILEPLLGGLDKGYRLHKWLGISGLVLGITHWLWGKGPKWAVGWGWLERPQRGPRPEQTVEIFRFFQEQRGLAETIGEWAFYAFVVAAAIALTKRFPYRRFFQIHRVLAVVYLALVAHSVILLPFSYWGTAVGVVMGVLMAAGSYAAVKSLRGQIGRSHRAAAEIETLVRHPGNQVLEVGLRLKSPWRGHDAGQFAFVTFDRREGPHPFTISSAWKGDGRLVFMIKALGDYTKTLPETLSVGSPVEVEGPYGRFDFSGDQAHQIWVAGGIGITPFIARLQGLAGEPSHPPVDLFYSTSAPDENFIASIRELAERARVRLHVLAADRDGRLDADGICRHVPDWQAAGLWFCGPAGFGQALRRGFSAKGLAGERFHQELFEMR

SEQ ID NO: 140 - protein, 445 aa, Stanieria cyanosphaera ATCC 29371
MKRLLMSSPVAVAAFWIAIYIVITLLPLLVLLFYFPPEGRGFWVEFSVALGFIGLAMMALQFALTARINRIEASYGVDIILQFHRYISLVAFCLILIHPLILFVTEPETLQLLNFPQAPWRARYAVIATLALIILVVTSVWRKRFNIPYEFWRTSHGILAVTAVTLGLAHALGVSYYLSFFWKTILWSAIAIIALLLLIYVRVIKPWFMVKKAYLVEEVIPQRGDVWTLALRSRGHEGMHFQPGQFAWITLAISPFRMREHPFSMSSSAVNPERLEFSIKALGDFTNHIKDVKPGTKAYLDGPYGVFTTDRYWDSAGFVLIAGGIGITPMMSMLVTAAERQDDRSFLLIYASKRWEDITFREELEALKDKIDLTIIHVLREPPEDWTGETGYVNRELLEKYIPIHRGSRHYFICAAPVMMDQVESDLHSLDVPVTNVHMEHFNLV

SEQ ID NO: 141 - protein, 381 aa, Streptococcus pneumoniae SPNA45
MKSIKELLFIIASFILTLLTWMNTSPQFMIPGLALTSLSLTFILATRLPLLESWFHGLEKVYTVHKFTAFLSIILLIFHNFSMGGLWGSRLAAQFGNLAIYIFASIILVAYLGKYIQYEAWRWIHRLVYLAYILGLFHIYMIMGNRLLTFNLLSFLVGSYALLGLLAGFYIIFLYQKISFPYLGKITHLKRLNHDTREIQIHLSRPFNYQSGQFAFLKIFQEGFESAPHPFSISGGHGQTLYFTIKNSGDHTKNIYDNLQAGSKVTLDRAYGHMIIEEGRENQVWIAGGIGITPFISYIREHPILDKQVHFYYSFRGDENAVYLDLLRNYAQKNPNFEQKEVPEHATIYMCGPISMMKALAKQIKKQNPKTELIYEGFKFK

SEQ ID NO: 142 - protein, 398 aa, Streptococcus sanguinis SK1056
MKSIKGIALIAVSIILTIFAWASAGMTNFIVPGLALTTLSLTFLLATRNALLEKWFHGIEKMYAYHKFTAIFSVVLLALHNVAMGGSLWGSHLAAQLGNVGIYLFVSIVLVAYLGKHIKYEAWRWIHRFVYLAYIFGLFHAYMLMGGRLLTPTLLGFVVGFYAIIGLAAGFYIIFLYQSLAFRHLGKILQVKRLNHDTVELKIQLSQKLDYQYGQFAFVKIFQEGFEKAPHPFSISGGHDNIVYFTIKNSGDHTKKLYDKIQEGTKVTIDRAYGHMILDQGQEKQIWIAGGIGITPFISYIRENPNLNRPVSFYYAYTGAENAVYLDLLKDYAAKNPQFDLHLVDSKVFGYLDFKNYPLDDKTTVFMCGPVKMMDKLANEFKKTNPKADLVYEGFKFK

SEQ ID NO: 143 - protein, 398 aa, Streptococcus sanguinis SK72
MKSIKGIALIAVSIILTIFAWASAGMTNFIVPGLALTTLSLTFLLATRNALLEKWFHGIEKMYAYHKFTAIFSVVLLALHNVAMGGSLWGSHLAAQLGNVGIYLFVSIVLVAYLGKHIKYEAWRWIHRFVYLAYIFGLFHAYMLMGGRLLTPTLLGFVVGFYAIIGLASGFYIIFLYQSLAFRHLGKIMQVKRLNHDTVELKIQLSQKLDYQYGQFAFVKIFQEGFEKAPHPFSISGGHDNIVYFTIKNSGDHTKKLYDKIQEGTKVTIDRAYGHMILDQGQEKQIWIAGGIGITPFISYIRENPKLNRPVSFYYAYTGTENAVYLDLLKDYATKNPQFDLHLVDSKVSGYLDFKNYPLDNQTTVFMCGPVKMMEKLANEFKKTNPKAELVYEGFKFK

SEQ ID NO: 144 - protein, 398 aa, Streptococcus sanguinis SK355
MKSIKGIALIAVSIILTIYAWASAGMTNFIVPGLALTTLSLTFLLATRNALLEKWFHGIEKMYAYHKFTAIFSVVLLALHNVAMGGSLWGSHLAAQLGNVGIYLFVSIVLVAYLGKHIKYEAWRWIHRFVYLAYIFGLFHAYMLMGDRLLTPTLLGFVVGFYAIIGLASGFYIIFLYQSLAFRHLGKIMQVKRLNHDTVELKIQLSQKLDYQYGQFAFVKIFQEGFEKAPHPFSISGGHDNIVYFTIKNSGDHTKKLYDKIQEGTKVTIDRAYGHMILDQGQEKQIWIAGGIGITPFISYIRENPNLNRPVSFYNAYTGTENAVYLDLLKDYAAKNPQFDLHLVDSKVSGYLDFKNYPLDNQTTVFMCGPVKMMDKLANEFKKTNPKADLVYEGFKFK

SEQ ID NO: 145 - protein, 398 aa, Streptococcus sanguinis VMC66
MKSIKGIALIAVSIILTIYAWASAGMTNFIVPGLALTTLSLTFLLATRNALLEKWFHGIEKMYAYHKFTAIFSVVLLALHNVAMGGSLWGSHLAAQLGNVGIYLFVSIVLVAYLGKHIKYEAWRWIHRFVYLAYIFGLFHAYMLMGGRLLTPTLLGFVVGFYAIIGLASGFYIIFLYQSLAFRHLGKILQVKRLNHDTVELKIQLSQKLDYQYGQFAFVKIFQEGFEQAPHPFSISGGHDNIVYFTIKNSGDHTKKLYDKIQEGTKVTIDRAYGHMILDQGQEKQIWIAGGIGITPFISYIRENPNLNRPVSFYYAYTGAENAVYLDLLKDYAAKNPQFDLHLVDSKVSGYLDFKNYPLDDKTTVFMCGPVKMMDKLANEFKKTNPKADLVYEGFKFK

SEQ ID NO: 146 - protein, 398 aa, Streptococcus sp. AS14
MKSIKGIALIAVSIILTIYAWASAGMTNFIVPGLALTTLSLTFLLATRNALLEKWFHGIEKMYAYHKFTAIFSVVLLALHNVAMGGSLWGSHLAAQLGNVGIYLFVSIVLVAYLGKHIKYEAWRWIHRFVYLAYIFGLFHAYMLMGGRLLTPTLLGFVVGFYAIIGLASGFYIIFLYQSLAFRHLGKILQVKRLNHDTVELKIQLSQKLDYQYGQFAFVKIFQEGFEQAPHPFSISGGHDNIVYFTIKNSGDHTKKLYDKIQEGTKVTIDRAYGHMILDQGQEKQIWIAGGIGITPFISYIRENPNLNRPVSFYYAYTGAENAVYLDLLKDYAAKNPQFDLHLVDSKVSGYLDFKNYPLDNQTTVFMCGPVKMMEKLANEFKKTNPKADLVYEGFKFK

SEQ ID NO: 147 - protein, 398 aa, Streptococcus sanguinis SK36
MKSIKGIALIAVSIILTIYAWASAGMTNFIVPGLALTTLSLTFLLATRNALLEKWFHGIEKMYAYHKFTAIFSVVLLALHNVAMGGSLWGSHLAAQLGNVGIYLFVSIVLVAYLGKHIKYEAWRWIHRFVYLAYIFGLFHAYMLMGGRLLTPTLLGFVVGFYAIIGLASGFYIIFLYQSLTFRHLGKILQVKRLNHDTVELKIQLSQKLDYQYGQFAFVKIFQEGFEKAPHPFSISGGHDNIVYFTIKNSGDHTKKLYDKIQEGTKVTIDRAYGHMILDQGQEKQIWIAGGIGITPFISYIRENPNLNRPVSFYYAYTGAENAVYLDLLKDYAAKNPQFDLHLVDSKVSGYLDFKNYPLDNQTTVFMCGPVKMMDKLANEFKKTNPKADLVYEGFKFK

SEQ ID NO: 148 - protein, 398 aa, Streptococcus sanguinis SK150
MKSIKGIALIAVSIILTIYAWASAGMTNFIVPGLALTTLSLTFLLATRNSLLEKWFHGIEKMYAYHKFTAIFSVVLLALHNVAMGGSLWGSHLAAQLGNVGIYLFVSIVLVAYLGKHIKYEAWRWIHRFVYLAYIFGLFHAYMLMGGRLLTPTLLGFVVGFYAIIGLASGFYIIFLYQSLAFRHLGKIIQVKRLNHDTVELKIQLSQKLDYQYGQFAFVKIFQEGFEKAPHPFSISGGHDNIVYFTIKNSGDHTKKLYDKIQEGTKVTIDRAYGHMILDQGQEKQIWIAGGIGITPFISYIRENPNLNRPVSFYYAYTGAENAVYLDLLKDYAAKNPQFDLHLVDSKVSGYLDFKNYPLDDKTTVFMCGPVKMMDKLANEFKKTNPKADLVYEGFKFK

SEQ ID NO: 149 - protein, 398 aa, Streptococcus sanguinis SK678
MKSIKGIALIAVSIILTIYAWASAGMTNFIVPGLALTTLSLTFLLATRNSLLEKWFHGIEKMYAYHKFTAIFSVVLLALHNVAMGGSLWGSHLAAQLGNVGIYLFVSIVLVAYLGKHIKYEAWRWIHRFVYLAYIFGLFHAYMLMGGRLLTPTLLGFVVGFYAIIGLASGFYIIFLYQSLAFRHLGKILQVKRLNHDTVELKIQLNQKLDYQYGQFAFVKIFQEGFEKAPHPFSISGGHDNIVYFTIKNSGDHTKKLYDKIQEGTKVTIDRAYGHMILDQGQEKQIWIAGGIGITPFISYIRENPNLDRPVSFYYAYTGAENAVYLDLLKDYVAKNPQFDLHLVDSKVSGYLDFKNYPLDNQTTVFMCGPVKMMEKLADEFKKTNPKADLVYEGFKFK

SEQ ID NO: 150 - protein, 398 aa, Streptococcus sanguinis SK1
MKSIKGIALIAVSIILTIYAWASAGMTNFIVPGLALTTLSMTFLLATRNALLEKWFNGIEKMYAYHKFTAIFSVVLLALHNVAMGGSLWGSHLAAQLGNVGIYLFVSIVLVAYLGKHIKYEAWRWIHRFVYLAYIFGLFHAYMLMGGRFLTPTLLGFIVGFYAIIGLASGFYIIFLYQSLAFRHLGKILQVKRLNHDTVELKIQLSQKLDYQYGQFAFVKIFQEGFEKAPHPFSISGGHDNIVYFTIKNSGDHTKKLYDKIQEGTKVTIDRAYGHMILDQGQEKQIWIAGGIGITPFISYIRENPNLNRPVSFYYAYTGAENAVYLDLLKDYEAKNPQFDLHLIDSKVSGYLDFKNYPLDDKTTVFMCGPVKMMDKLANEFKKTNPKADLVYEGFKFK

SEQ ID NO: 151 - protein, 398 aa, Streptococcus sanguinis SK330
MKSIKGIALIAVSILLTIYAWASAGMTNFIVPGLALTTLSLTFLLATRNALLEKWFHGIEKMYAYHKFTAIFSVVLLALHNVAMGGSLWGSHLAAQLGNVGIYLFVSIVLVAYLGKHIKYEAWRWIHRFVYLAYIFGLFHAYMLMGGRLLTPTLLGFVVGFYAIIGLASGFYIIFLYQSLAFRHLGKILQVKRLNHDTVELKIQLSQKLDYQYGQFAFVKIFQEGFEKAPHPFSISGGHDNIVYFTIKNSGDHTKKLYDKIQEGTKVTIDRAYGHMILDQGQEKQIWIAGGIGITPFISYIRENPKLNRPVSFYYAYTGAENAVYLDLLKDYAAKNPQFNLHLVDSKVSGYLDFKNYPLDNQTTVFMCGPVKMMDKLANEFKKTNPKADLVYEGFKFK

SEQ ID NO: 152 - protein, 398 aa, Streptococcus sanguinis SK1057
MKSIKGIALIAVSILLTIYAWASAGMTNFIVPGLALTTLSLTFLLATRNALLEKWFHGIEKMYAYHKFTAIFSVVLLALHNVAMGGSLWGSLLAAQLGNVGIYLFVSIVLVAYLGKHIKYEAWRWIHRFVYLAYIFGLFHAYMLMGGRLLTPTLLGFVVGFYAIIGLASGFYIILLYQSLAFRHLGKILQVKRLNHDTVELKIQLSQKLDYQYGQFAFVKIFQEGFEKAPHPFSISGGHDNIVYFTIKNSGDHTKKLYDKIQEGTKVTIDRAYGHMILDQGQEKQIWIAGGIGITPFISYIRENPNLNRPVSFYYAYTGAENAVYLDLLKDYAARNPLFDLHLVDSKVSGYLDFKNYPLDDKTTVFMCGPVKMMDKLANEFKKTNPKADLVYEGFKFK

SEQ ID NO: 153 - protein, 398 aa, Streptococcus gordonii ATCC 35105
MKSIKGIALIAVSILLTIYAWASAGMTNFIVPGLALTTLSLTFLLATRNALLEKWFHGIENMYAYHKFTAIFSVVLLALHNVAMGGSLWGSHLAAQLGNVGIYLFVSIVLVAYLGKHIKYEAWRWIHRFVYLAYIFGLFHAYMLMGGRLLTPTLLGFVVGFYAIIGLASGFYIIFLYQSLAFRHLGKIMQVKRLNHDTVELKIQLSQKLDYQYGQFAFVKIFQEGFEKAPHPFSISGGHDNIVYFTIKNSGDHTKKLYDKIQEGTKVTIDRAYGHMILDQGQEKQIWIAGGIGITPFISYIRENPNLNRPVSFYYAYTGAENAVYLDLLKDYAAKNPQFDLHLVDSKVSGYLDFKNYPLDNQTTIFMCGPVKMMDKLASEFKKTNPKADLVYEGFKFK

SEQ ID NO: 154 - protein, 398 aa, Streptococcus cristatus ATCC 51100
MKSIKGIALIAVSIVLTIYAWASAGMTNFIVPGLALTTLSLTFLLATRNALLEKWFNGIEKMYAYHKFIAIFSVVLLALHNVAMGGSLWGSHLAGQLGNVGIYLFVSIVLVAYLGKHIKYEAWRWIHRFVYLAYIFGLFHAYMLMGGRLLKPTLLGFVVGFYAIIGLASGFYIIFLYQSLAFRHLGKILQVKRLNHDTVELKIQLSQKLDYQYGQFAFVKIFQEGFEKAPHPFSISGGHDNIVYFTIKNSGDHTKKLYDKIQEGTKVTIDRAYGHMILDQGQEKQIWIAGGIGITPFISYIRENPNLNRPVSFYYAYTGDENAVYLDLLTDYAAKNPQFDLHLVDSKVSGYLDFKNYPLDDKTTVFMCGPVKMMDKLANEFKKTKPKADLVYEGFKFK

SEQ ID NO: 155 - protein, 398 aa, Leptotrichia sp. oral F0557
MKSIKGITFIFASIAITLYAWISAGAIRNITAGLALTTLSLTFMLATRVKLLEKWFNGIEKMYFYHKLMAVFSVILLVMHHKSKGFGLWSERIPARLGNIAIYLFISVVIVAYISKKLKYETWRWIHRIVFIAYIIGLWHGFTYSRKAFTSVNLLSLVIEVYAVLGLVSGIYIIFLYQKIGFKNNGKIVSVKRLNHDTTELEIELDKNFDYKYGQFAFIKIFQEGFEKAPHPFSISGGKGNKIFFTIKNSGDYTSDIYQNLKEGTKVKIDRAYGHMLLEKGKEKQIWIAGGIGVTPFISYIRENEKIDGNIDFYYAYTGEENAVHIDMMKQFAQKNPNFKLNLVDSKVSGYLNFDNYKLENGTTVFMCGSVKMMDNFATVFKKLNSNVELVYEGFKFK

SEQ ID NO: 156 - protein, 398 aa, Streptococcus sp. 2_1_36FAA
MKSIKGLALITVSILLTIYAWASAGMTNFIVPGLALTTLSLTFLLATRNALLEKWFHGIEKMYAYHKFTAIFSVVLLALHNVAMGGSLWGSHLAAQLGNVGIYLFVSIVLVAYLGKHIKYEAWRWIHRFVYLAYIFGLFHAYMLMGGRLLTPTLLGFVVGFYAITGLASGFYIIFLYQSLAFRHLGKILQVKRLNHDTVELKIQLSQKLDYQYGQFAFVKIFQEGFEKAPHPFSISGGHDNIVYFTIKNSGDHTKKLYNKIQEGTKITIDRAYGHMILDQGQEKQIWIAGGIGITPFISYIRENPNLDRPVSFYYAYTGAENAVYLDLLKDYATKNPQFDLHLVDSKVSGYLDFKNYPLDDKTTVFMCGPVKMMDKLANEFKKTNPKADLVYEGFKFK

SEQ ID NO: 157 - protein, 396 aa, Streptococcus mitis 17/34
MKSIKGLLFIIASFALTILTWMNTSPQFMIPGLALTSLSLTFILATRLPIIESWFHGLEKVYTVHKFTAFLSIILLIFHNFSMGGLWGSRLATQFGNLAIYIFISIILVAYLGKYIQYEAWRWIHRLVYLAYIFGLFHVYMIMGNRLLTFNLLSFLVGSYALLGLLAGFYIIFLYQKIGFPYLGKITNLKRLNHDTIEIQIHLSRPFNYQSGQFAFLKIFQEGFESAPHPFSVSGGHGQTLYFTVKNSGDHTKNIYDNLQVGSKVSVDRAYGHMIIEEVQENQVWIAGGIGITPFISYIREHPILDKQVHFYYSFRGEENAVYLDLLRDYAQKNPNFELHLVDSIKDGYLNFDQEEVTEHATVYMCGPLSMMKSLAKQIKKQNPKAELIYEGFKFK

SEQ ID NO: 158 - protein, 396 aa, Streptococcus mitis NCTC 12261
MKSIKGLLFIIASFILTILTWMNTSPQFMIPGLALTSLSLTFILATRLPLIENWFHGLEKVYTVHKFTAFLSIILLIFHNFSMGGLWGSRLATQFGNLAIYIFVSIILVAYLGKYIQYEAWRWIHRLVYLAYIFGLLHVYMMMGNRLLTFNLLSFLVGSYALLGLLAGFYIIFLYQKIGFPYLGKITNLKHLNHDTREIQIHLSRPFNYQSGQFAFLKIFQEGFESAPHPFSISGGHGQTLYFTVKNSGDHTKNIYDNLQVGSKVSVDRAYGHMIIKEGRENQVWIAGGIGITPFISYIREHPILDKQVHFYYSFHGEENAVYLDLLRDYAQKNPNFELHLVDSRKDGYLNFDQEKVPDHASVYMCGPLSMMKSLAKQIKKESPKTELIYEGFKFK

SEQ ID NO: 159 - protein, 396 aa, Streptococcus mitis SK569
MKSIKGLLFIIASFILTILTWMNTSPQFMIPGLALTSLSLTFILATRLPLLESWFHGLEKVYTVHKFTALLSIILLIFHNFSMGGLWGSRLAAQFGNLAIYIFVSIILVAYLGKYIQYEAWRWIHRLVYLAYIFGLFHVYMMMGNRLLTFNLLSFLVGSYSLLGLLAGFYIIFLYQKIGFPYLGKITKLKRLNHDTREIQIHLSRPFNYQSGQFAFLKIFQEGFESAPHPFSISGGHGQTLYFTVKNSGDHTKNIYDNLQVGSKVSVDRAYGHMIIEKGRKNQVWIAGGIGITPFISYIREHPIVDKKVHFYYSFRGEENAVYLDLLRDFAQKNPNFELHLVDSRKDGYLHFEQKEVPEHASVYMCGPLSMMKSLAKQIKKQNPKAELIYEGFKFK

SEQ ID NO: 160 - protein, 396 aa, Streptococcus mitis 29/42
MKSIKGLLFIIASFILTILTWMNTYPQFMIPGLALTSLSLTFILATRLPLLESWFHGLEKVYTVHKFTAFLSIILLIFHNFSMGGLWGSRLAAQFGNLAIYIFVSIILVAYLGKYIQYEAWRWIHRLIYLAYIFGLFHVYMMMGNRLLTFNLLSFLVGSYALLGLLAGFYIIFLYQKIGFPYLGKITNLKRLNHDTIEIQIHLSRPFNYQAGQFAFLKIFQEGFESAPHPFSISGGQGQTLYFTVKNSGDHTKNIYDNLQVGSKVTVDKAYGHMTIEEGRKNQVWIAGGIGITPFISYIREHPILDKQVHFYYSFHGEENAVYLDLLRDYAQKNPNFELHLVDSRKDGYLNFDQEKVPDHASVYMCGPLSMMKSLAKQIKKESPKAELIYEGFKFK

SEQ ID NO: 161 - protein, 396 aa, Streptococcus pneumoniae MNZ85
MKSIKGLLFIIASFILTLLTWMNTSPQFMIPGLALTSLSLTFILATRLPLLESWFHGLEKVYTAHKFTAFLSIILLIFHNFSMGGLWGSRLAAQFGNLAIYIFVSIILVAYLGKYIQYEAWRWIHRMVYLAYIFGLFHVYMMMGNRLLTFNLLSFLVGSSALLGLLAGFYIIFLYQKISFPYLGKITHLKRLNHDTREIQIHLSRPFNYQAGQFAFLKIFQEGFESAPHPFSISGGHGQTLYFTVKNSGDHTKNIYDNLQVGSKVTLDRAYGHMIIEEGRENQVWIAGGIGITPFISYIREHPILDKQVHFYYNFRGDENAVYLDLLRNYAQKNPNFELHLIDSTKDGYLNFEQKEVPEHATVYMCGPISMMKALAKQIKKQNPKTELIYEGFKFK

SEQ ID NO: 162 - protein, 396 aa, Streptococcus pneumoniae GA43380
MKSIKGLLFIIASFILTLLTWMNTSPQFMIPGLALTSLSLTFILATRLPLLESWFHGLEKVYTVHKFTAFLSIILLIFHNFSMGGLWGSRLAAQFGNLAIYIFASIILVAYLGKYIQYEAWRWIHRLVYLAYILGLFHIYMIMGNRLLTFNLLSFLVGSYALLGLLADFYIIFLYQKISFPYLGKITHLKRLNHDTREIQIHLSRPFNYQSGQFAFLKIFQEGFESAPHPFSISGGHGQTLYFTVKNSGDHTKNIYDNLQAGSKVTLDRAYGHMIIEEGRENQVWIAGGIGITPFISYIREHPILDKRVHFYYSFRGEENAVYLDLLRDYAQKNPNFELHLIDSTKDGYLNFEQKEVPEHATVYMCSPISMMKALAKQIKKQNPKTELIYEGFKFK

SEQ ID NO: 163 - protein, 396 aa, Streptococcus pneumoniae 2061617
MKSIKGLLFIIASFILTLLTWMNTSPQFMIPGLALTSLSLTFILATRLPLLESWFHGLEKVYTVHKFTAFLSIILLIFHNFSMGGLWGSRLAAQFGNLAIYIFASIILVAYLGKYIQYEAWRWIHRLVYLAYILGLFHIYMIMGNRLLTFNLLSFLVGSYALLGLLAGFYIIFLYQKISFPYLGKITHLKRLNHDTREIQIHLCRPFNYQSGQFAFLKIFQEGFESAPHPFSISGGHGQTLYFTVKNSGDHTKNIYDNLQAGSKVTLDRAYGHMIIEEGRENQVWIAGGIGITPFISYIREHPILDKQVHFYYSFRGDENAVYLDLLRNYAQKNPNFELHLIDSTKDGYLNFEQKEVPEHATVYMCGPISMMKALAKQIKKQNPKTELIYEGFKFK

SEQ ID NO: 164 - protein, 396 aa, Streptococcus pneumoniae GA47502
MKSIKGLLFIIASFILTLLTWMNTSPQFMIPGLALTSLSLTFILATRLPLLESWFHGLEKVYTVHKFTAFLSIILLIFHNFSMGGLWGSRLAAQFGNLAIYIFASIILVAYLGKYIQYEAWRWIHRLVYLAYILGLFHIYMIMGNRLLTFNLLSFLVGSYALLGLLAGFYIIFLYQKISFPYLGKITHLKRLNHDTREIQIHLCRPFNYQSGQFAFLKIFQEGFESAPHPFSISGGHGQTLYFTVKNSGDHTKNIYDNLQAGSKVTLDRAYGHMIIEEGRENQVWIAGGIGITPFISYIREHPILDKRVHFYYSFRGEENAVYLDLLRDYAQKNPNFELHLIDSTKDGYLNFEQKEVPEHATVYMCGPISMMKALAKQIKKQNPKTELIYEGFKFK

SEQ ID NO: 165 - protein, 396 aa, Streptococcus pneumoniae 1488
MKSIKGLLFIIASFILTLLTWMNTSPQFMIPGLALTSLSLTFILATRLPLLESWFHGLEKVYTVHKFTAFLSIILLIFHNFSMGGLWGSRLAAQFGNLAIYIFASIILVAYLGKYIQYEAWRWIHRLVYLAYILGLFHIYMIMGNRLLTFNLLSFLVGSYALLGLLAGFYIIFLYQKISFPYLGKITHLKRLNHDTREIQIHLCRPFNYQSGQFAFLKIFQEGFESAPHPFSISGGHGQTLYFTVKNSGDHTNNIYDNLQAGSKVTLDRAYGHMIIEEGRENQVWIAGGIGITPFISYIREHPILDKQVHFYYSFRGDENAVYLDLLRNYAQKNPNFELHLIDSTKDGYLNFEQKEVPEHATVYMCGPISMMKALAKQIKKQNPKTELIYEGFKFK

SEQ ID NO: 166 - protein, 396 aa, Streptococcus pneumoniae GA60132
MKSIKGLLFIIASFILTLLTWMNTSPQFMIPGLALTSLSLTFILATRLPLLESWFHGLEKVYTVHKFTAFLSIILLIFHNFSMGGLWGSRLAAQFGNLAIYIFASIILVAYLGKYIQYEAWRWIHRLVYLAYILGLFHIYMIMGNRLLTFNLLSFLVGSYALLGLLAGFYIIFLYQKISFPYLGKITHLKRLNHDTREIQIHLCRPFNYQSGQFAFLKIFQEGFESAPHPFSISGGHGQTLYFTVKNSGDHTNNIYDNLQAGSKVTLDRAYGHMIIEEGRENQVWIAGGIGITPFISYIREHPILDKQVHFYYSFRGDENAVYLDLLRNYAQKNPNFELHLIDSTKDGYLNFEQKEVPEHATVYMCGPISMMKALAKQIKKQNPKTELTYEGFKFK

SEQ ID NO: 167 - protein, 396 aa, Streptococcus pneumoniae GA04375
MKSIKGLLFIIASFILTLLTWMNTSPQFMIPGLALTSLSLTFILATRLPLLESWFHGLEKVYTVHKFTAFLSIILLIFHNFSMGGLWGSRLAAQFGNLAIYIFASIILVAYLGKYIQYEAWRWIHRLVYLAYILGLFHIYMIMGNRLLTFNLLSFLVGSYALLGLLAGFYIIFLYQKISFPYLGKITHLKRLNHDTREIQIHLSRPFNYQSGQFAFLKIFQEGFESAPHPFSISGGHGQTLYFTVKNSGDHTKNIYDNLQAGSKVTLDRAYGHMIIEEGRENQVWIAGGIGITPFISYIREHPILDKQVHFYYSFRGDENAVYLDLLRNYAQKNPNFELHLIDSTKDGYLNFEQKEVPEHATVYMCGPISMMKALAKQIKKQNPKTELIYEGFKFK

SEQ ID NO: 168 - protein, 396 aa, Streptococcus pneumoniae SP6-BS73
MKSIKGLLFIIASFILTLLTWMNTSPQFMIPGLALTSLSLTFILATRLPLLESWFHGLEKVYTVHKFTAFLSIILLIFHNFSMGGLWGSRLAAQFGNLAIYIFASIILVAYLGKYIQYEAWRWIHRLVYLAYILGLFHIYMIMGNRLLTFNLLSFLVGSYALLGLLAGFYIIFLYQKISFPYLGKITHLKRLNHDTREIQIHLSRPFNYQSGQFAFLKIFQEGFESAPHPFSISGGHGQTLYFTVKNSGDHTKNIYDNLQAGSKVTLDRAYGHMIIEEGRENQVWIAGGIGITPFISYIREHPILDKRVHFYYSFRGEENAVYLDLLRDYAQKNPNFELHLIDSTKDGYLNFEQKEVPEHATVYMCSPISMMKALAKQIKKQNPKTELIYEGFKFK

SEQ ID NO: 169 - protein, 396 aa, Streptococcus pseudopneumoniae IS7493
MKSIKGLLFIIASFILTLLTWMNTSPQFMIPGLALTSLSLTFILATRLPLLESWFHGLEKVYTVHKFTAFLSIILLIFHNFSMGGLWGSRLAAQFGNLAIYIFASIILVAYLGKYIQYEAWRWIHRLVYLAYILGLFHIYMIMGNRLLTFNLLSFLVGSYALLGLLAGFYIIFLYQKISFPYLGKITHLKRLNHDTREIQIHLSRPFNYQSGQFAFLKIFQEGFESAPHPFSISGGHGQTLYFTVKNSGDHTNNIYDNLQAGSKVTLDRAYGHMIIEEGRENQVWIAGGIGITPFISYIREHPILDKQVHFYYSFRGDENAVYLDLLRNYAQKNPNFELHLIDSTKDGYLNFEQKEVPEHATVYMCGPLSMMKTLAKQIKKQNPKAELIYEGFKFK

SEQ ID NO: 170 - protein, 396 aa, Streptococcus pseudopneumoniae ATCC BAA-960
MKSIKGLLFIIASFILTLLTWMNTSPQFMIPGLALTSLSLTFILATRLPLLESWFHGLEKVYTVHKFTAFLSIILLIFHNFSMGGLWGSRLAAQFGNLAIYIFASIILVAYLGKYIQYEAWRWIHRLVYLAYILGLFHIYMIMGNRLLTFNLLSFLVGSYALLGLLAGFYIIFLYQKISFPYLGKITHLKRLNHDTREIQIHLSRPFNYQSGQFAFLKIFQEGFESAPHPFSISGGHGQTLYFTVKNSGDHTNNIYDNLQAGSKVTLDRAYGHMIIEEGRENQVWIAGGIGITPFISYIREHPILDKQVHFYYSFRGDENAVYLDLLRNYAQKNPNFELHLIDSTKDGYLNFEQKEVPKHATVYMCGPLSMMKTLAKQIKKQNPKAELIYEGFKFK

SEQ ID NO: 171 - protein, 396 aa, Streptococcus mitis SK616
MKSIKGLLFIISSFILTILTWMNTSPQFMIPGLALTSLSLTFILATRLPLLESWFHGLEKVYTVHKFTAFLSIILLIFHNFSMGGLWGSRLAAQFGNLAIYIFVSIILVAYLGQYIQYEAWRWIHRLVYLAYIFGLFHVYMMMGNRLLTFNLLSFLVGSYALLGLLAGFYIIFLYQKIGFPYLGKITNLKRLNHDTREIQIHLSRPFNYQSGQFAFLKILQEGFESAPHPFSISGGHGQTLYFTVKNSGDHTKNIYDNLQVGSKVSVDRAYGHMIIEEGRENQVWIAGGIGITPFISYIREHPIVDKQVHFYYSFRGEENVVYLDLLRDYAQKNSNFELHLVDSTKDGYLHFEQEEVPEHASVYMCGPLSMMKSLAKQIKKQNLKAELIYEGFKFK

SEQ ID NO: 172 - protein, 396 aa, Streptococcus mitis SK579
MKSLKGILFIITSFVLTILTWMSTSPQFMIPGLALTSLSLTFILATRLPIIESWFHGLEKVYTVHKFTAFLSIILLIFHNFSMGGLWGTRLAAQFGNLAIYIFVSIILVAYLGKYIQYEAWRWIHRLVYLAYIFGLFHVYMIMGNRLLTFNPLSFVVGSYALLGLLAGFYIIFLYQKIGFPYLGKITNLKRLNHDTREIQIHLSRPFNYQSGQFAFLRIFQEGFESAPHPFSISGGHGQTLYFTVKNSGDHTKNIYNNLQVGSKVSVDRAYGHMIIEEGQENQVWIAGGIGITPFISYIREHPILDKRVHFYYSFRGEENAVYLDLLRDYAQKNPNFELHLVDSIKDGYLNFDQEEVPEHATVYMCGPLSMMKSLAKQIKKQNPKAELIYEGFKFK

SEQ ID NO: 173 - protein, 396 aa, Streptococcus mitis SK597
MKSLKGLLFIIASFILTILTWMNTPPQFMIPGLALTSLSLTFILATRLPLLESWFHGLEKVYTVHKFTAFLSIILLIFHNFSMGGLWGSRLAAQFGNLAIYIFISIIIVAYLGKYIQYEAWRWIHRLVYLAYIFELFHVYMMIGNRLLTFNLLSFLVGSYALLGLLAGFYIIFLYQKIGFPYLGKITNLKRLNHDTREIQIHLSRPFNYQSGQFAFLKIFQEGFESAPHPFSISGGHGQTLYFTVKNSGDHTKNIYDNLQVGSRVSVDRAYGHMIIEEGRENQVWIAGGIGITPFISYIREHPILDKQVHFYYSFRGEENAVYLDLLRDYDQKNPNFELHLVDSRKDGYLNFEQKEVPEHASVYMCGPLSMMKSLAKQIKKQNPKTELIYEGFKFK

SEQ ID NO: 174 - protein, 396 aa, Streptococcus mitis 13/39
MKSLKGLLFIIASFVLTILTWMNTSPQFMIPGLALTSLSLTFILATRLPLLENWFHGLEKVYTVHKFTAFLSIILLIFHNFSMGGLWGSRLAAQFGNLAIYIFVSIILVAYLGKYIQYEAWRWIHRLVYLAYIFGLFHVYMMMGNRLLTFNLLSFLVGSYALLGMLAGFYIIFLYQKIGFPYLGKITNLKRLNHDTREIQIHLSRPFNYQAGQFAFLKIFQEGFESAPHPFSISGGHGQTLYFTVKNSGDHTKNIYDNLQVGSKVSVDRAYGHMIIEEGRENQVWIAGGIGITPFISYIREHPILDKQVHFYYSFRGEENAVYLDLLRDYAQKNPNFELHLVDSRKDGYLNFEQKEVPKHASVYICGPLSMMKSLAKQMKKQNPKAELIYEGFKFK

SEQ ID NO: 175 - protein, 396 aa, Streptococcus mitis SK1073
MKSLKGLLFIIASFVLTILTWMNTSPQFMIPGLALTSLSLTFILATRLPLLESWFHGLEKVYTVHKFTAFLSIILLIFHNFSMGGLWGSRLAAQFGNLAIYIFVSIILVAYLGKYIQYEAWRWIHRLVYLAYIFGLFHVYMMMGNLLLTFNLLSFLVGSYALLGLLAGFYIIFLYQKIGFPYLGKITNLKRLNHDTKEIQIHLSRPFNYQSGQFAFLKIFQEGFESAPHPFSISGGHGQTLYFTVKNSGDHTKNIYDNLQVGSKVSVDRAYGHMIIEEGRENQVWIAGGIGITPFISYIREHPILDKQVHFYYSFRGKENAVYLDLLRDYDQKNSNFELHLVDSRKDGYLHFEQKEMPEQATIYMCGPLSMMKSLAKQIKKQNPKAELIYEGFKFK

SEQ ID NO: 176 - protein, 397 aa, Streptococcus oralis ATCC 35037
MKSLKGVLFIGLSMLLTILAWLSSGASQFLIPGLALTTLSLTFILASRLPLLEAWFNGLEKMYLAHKFTAFLSILLLILHNFSMGGLWGSHLAAQFGNIAIYIFISIVLVAYLGQYIQYEAWRWIHRLVYLAYIFGLFHVLMIMGNRLLSFSFLGLIFGIYAILGLLAGFYIIFLYQKIGFTYLGKIVGIKRLNHDTTEIEIELSHPFTYEYGQFAFLKIFQKGFETAPHPFSISGGQGRTLYFTIKNSGDHTKNIYDNLQVGSKVAVDRAYGHMTMEHGPKQQIWIAGGIGITPFISYIREHPILDRNVRFYYSFRGEENAVYLDLLRDYARQNANFDLQLVDSNEKGYLTLDQEEIPTQTTVYMCGPLPMMKALAKQIKKKNPKAKLIYEGFKFK

SEQ ID NO: 177 - protein, 396 aa, Streptococcus pneumoniae SP9-BS68
MKSVKGLLFIIASFILTLLTWMNTSPQFMIPGLALTSLSLTFILATRLPLLESWFHGLEKVYTVHKFTAFLSIILLIFHNFSMGGLWGSRLAAQFGNLAIYIFAGIILVAYLGKYIQYEAWRWIHRLVYLAYILGLFHIYMIMGNRLLTFNLLSFLVGSYALLGLLAGFYIIFLYQKISFPYLGKITHLKRLNHDTREIQIHLSRPFNYQSGQFAFLKIFQEGFESAPHPFSISGGHGQTLYFTVKNSGDHTKNIYDNLQAGSKVTLDRAYGHMIIEEGRENQVWIAGGIGITPFISYIREHPILDKRVHFYYSFRGEENAVYLDLLRDYAQKNPNFELHLIDSTKDGYLNFEQKEVPEHATVYMCGPISMMKALAKQIKKQNPKTELIYEGFKFK

SEQ ID NO: 178 - protein, 396 aa, Streptococcus pneumoniae 2070005
MKSVKGLLFIIASFILTLLTWMNTSPQFMIPGLALTSLSLTFILATRLPLLESWFHGLEKVYTVHKFTAFLSIILLIFHNFSMGGLWGSRLAAQFGNLAIYIFASIILVAYLGKYIQYEAWRWIHRLVYLAYILGLFHIYMIMGNRLLTFNLLSFLVGSYALLGLLAGFYIIFLYQKISFPYLGKIIHLKRLNHDTREIQIHLSRPFNYQSGQFAFLKIFQEGFESAPHPFSISGGHGQTLYFTVKNSGDHTNNIYDNLQAGSKVTLDRAYGHMIIEEGRENQVWIAGGIGITPFISYIREHPILDKQVHFYYSFRGDENAVYLDLLRNYAQKNPNFELHLIDSTKDGYLNFEQKEVPEHATVYMCAPISMMKALAKQIKKQNPKTELIYEGFKFK

SEQ ID NO: 179 - protein, 396 aa, Streptococcus pneumoniae SP23-BS72
MKSVKGLLFIIASFILTLLTWMNTSPQFMIPGLALTSLSLTFILATRLPLLESWFHGLEKVYTVHKFTAFLSIILLIFHNFSMGGLWGSRLAAQFGNLAIYIFASIILVAYLGKYIQYEAWRWIHRLVYLAYILGLFHIYMIMGNRLLTFNLLSFLVGSYALLGLLAGFYIIFLYQKISFPYLGKIIHLKRLNHDTREIQIHLSRPFNYQSGQFAFLKIFQEGFESAPHPFSISGGHGQTLYFTVKNSGDHTNNIYDNLQAGSKVTLDRAYGHMIIEEGRENQVWIAGGIGITPFISYIREHPILDKQVHFYYSFRGDENAVYLDLLRNYAQKNPNFELHLIDSTKDGYLNFEQKEVPEHATVYMCGPISMMKALAKQIKKQNPKTELIYEGFKFK

SEQ ID NO: 180 - protein, 396 aa, Streptococcus pneumoniae CDC0288-04
MKSVKGLLFIIASFILTLLTWMNTSPQFMIPGLALTSLSLTFILATRLPLLESWFHGLEKVYTVHKFTAFLSIILLIFHNFSMGGLWGSRLAAQFGNLAIYIFASIILVAYLGKYIQYEAWRWIHRLVYLAYILGLFHIYMIMGNRLLTFNLLSFLVGSYALLGLLAGFYIIFLYQKISFPYLGKITHLKRLNHDTREIQIHLCRPFNYQSGQFAFLKIFQEGFESAPHPFSISGGHGQTLYFTVKNSGDHTNNIYDNLQAGSKVTLDRAYGHMIIEEGRENQVWIAGGIGITPFISYIREHPILDKQVHFYYSFRGDENAVYLDLLRNYAQKNPNFELHLIDSTKDGYLNFEQKEVPEHATVYMCGPISMMKALAKQIKKQNPKTELIYEGFKFK

SEQ ID NO: 181 - protein, 397 aa, Streptococcus pneumoniae 357
MKSVKGLLFIIASFILTLLTWMNTSPQFMIPGLALTSLSLTFILATRLPLLESWFHGLEKVYTVHKFTAFLSIILLIFHNFSMGGLWGSRLAAQFGNLAIYIFASIILVAYLGKYIQYEAWRWIHRLVYLAYILGLFHIYMIMGNRLLTFNLLSFLVGSYALLGLLAGFYIIFLYQKISFPYLGKITHLKRLNHDTREIQIHLCRPFNYQSGQFAFLKIFQEGFESAPHPFSISGGHGQTLYFTVKNSGDHTNNIYDNLQAGSKVTLDRAYGHMIIEEGRENQVWIAGGIGITPFISYIREHPILDKQVHFYYSFRGDENAVYLDLLRNYAQKNPNFELHLIDSTKDGYLNFEQKEVPEHATVYMCGPISMMKHLPNRLRNKIQKQSLFTKDSSSNK

SEQ ID NO: 182 - protein, 396 aa, Streptococcus pneumoniae SP11-BS70
MKSVKGLLFIIASFILTLLTWMNTSPQFMIPGLALTSLSLTFILATRLPLLESWFHGLEKVYTVHKFTAFLSIILLIFHNFSMGGLWGSRLAAQFGNLAIYIFASIILVAYLGKYIQYEAWRWIHRLVYLAYILGLFHIYMIMGNRLLTFNLLSFLVGSYALLGLLAGFYIIFLYQKISFPYLGKITHLKRLNHDTREIQIHLSRPFNYQSGQFAFLKIFQEGFESAPHPFSISGGHGQTLYFTIKNSGDHTKNIYDNLQAGSKVTLDRAYGHMIIEEGRENQVWIAGGIGITPFISYIREHPILDKQVHFYYSFRGDENAVYLDLLRNYAQKNPNFELHLIDSTKDGYLNFEQKEVPEHATVYMCGPISMMKALAKQIKKQNPKTELIYEGFKFK

SEQ ID NO: 183 - protein, 396 aa, Streptococcus pneumoniae GA40563
MKSVKGLLFIIASFILTLLTWMNTSPQFMIPGLALTSLSLTFILATRLPLLESWFHGLEKVYTVHKFTAFLSIILLIFHNFSMGGLWGSRLAAQFGNLAIYIFASIILVAYLGKYIQYEAWRWIHRLVYLAYILGLFHIYMIMGNRLLTFNLLSFLVGSYALLGLLAGFYIIFLYQKISFPYLGKITHLKRLNHDTREIQIHLSRPFNYQSGQFAFLKIFQEGFESAPHPFSISGGHGQTLYFTVKNSGDHTKNIYDNLQAGSKVTLDRAYGHMIIEEGRENQVWIAGGIGITPFISYIREHPILDKQVHFYYNFRGDENAVYLDLLRNYAQKNPNFELHLIDSTKDGYLNFEQKEVPEHATVYMCGPISMMKALAKQIKKQNPKTELIYEGFKFK

SEQ ID NO: 184 - protein, 396 aa, Streptococcus pneumoniae BS455
MKSVKGLLFIIASFILTLLTWMNTSPQFMIPGLALTSLSLTFILATRLPLLESWFHGLEKVYTVHKFTAFLSIILLIFHNFSMGGLWGSRLAAQFGNLAIYIFASIILVAYLGKYIQYEAWRWIHRLVYLAYILGLFHIYMIMGNRLLTFNLLSFLVGSYALLGLLAGFYIIFLYQKISFPYLGKITHLKRLNHDTREIQIHLSRPFNYQSGQFAFLKIFQEGFESAPHPFSISGGHGQTLYFTVKNSGDHTKNIYDNLQAGSKVTLDRAYGHMIIEEGRENQVWIAGGIGITPFISYIREHPILDKQVHFYYSFRGDENAVYLDLLRNYAQKNPNFELHLIDSTKDGYLNFEQKEVPEHATVYMCGPISMMKALAKQIKKQNPKTELIYEGFKFK

SEQ ID NO: 185 - protein, 370 aa, Streptococcus pneumoniae SP3-BS71
MKSVKGLLFIIASFILTLLTWMNTSPQFMIPGLALTSLSLTFILATRLPLLESWFHGLEKVYTVHKFTAFLSIILLIFHNFSMGGLWGSRLAAQFGNLAIYIFASIILVAYLGKYIQYEAWRWIHRLVYLAYILGLFHIYMIMGNRLLTFNLLSFLVGSYALLGLLAGFYIIFLYQKISFPYLGKITHLKRLNHDTREIQIHLSRPFNYQSGQFAFLKIFQEGFESAPHPFSISGGHGQTLYFTVKNSGDHTKNIYDNLQAGSKVTLDRAYGHMIIEEGRENQVWIAGGIGITPFISYIREHPILDKQVHFYYSFRGDENAVYLDLLRNYAQKNPNFELHLIDSTKDGYLNFEQKKCPNMQPSICVVLFL

SEQ ID NO: 186 - protein, 396 aa, Streptococcus pneumoniae SP14-BS69
MKSVKGLLFIIASFILTLLTWMNTSPQFMIPGLALTSLSLTFILATRLPLLESWFHGLEKVYTVHKFTAFLSIILLIFHNFSMGGLWGSRLAAQFGNLAIYIFASIILVAYLGKYIQYEAWRWIHRLVYLAYILGLFHIYMIMGNRLLTFNLLSFLVGSYALLGLLAGFYIIFLYQKISFPYLGKITHLKRLNHDTREIQIHLSRPFNYQSGQFAFLKIFQEGFESAPHPFSISGGHGQTLYFTVKNSGDHTKNIYDNLQAGSKVTLDRAYGHMIIEEGRENQVWIAGGIGITPFISYIREHPILDKQVHFYYSFRGDENAVYLDLLRNYAQKNPNFELHLIDSTKDGYLNFEQKKVPEHATVYMCGPISMMKALAKQIKKQNPKTELIYEGFKFK

SEQ ID NO: 187 - protein, 396 aa, Streptococcus pneumoniae SP18-BS74
MKSVKGLLFIIASFILTLLTWMNTSPQFMIPGLALTSLSLTFILATRLPLLESWFHGLEKVYTVHKFTAFLSIILLIFHNFSMGGLWGSRLAAQFGNLAIYIFASIILVAYLGKYIQYEAWRWIHRLVYLAYILGLFHIYMIMGNRLLTFNLLSFLVGSYALLGLLAGFYIIFLYQKISFPYLGKITHLKRLNHDTREIQIHLSRPFNYQSGQFAFLKIFQEGFESAPHPFSISGGHGQTLYFTVKNSGDHTKNIYDNLQAGSKVTLDRAYGHMIIEEGRENQVWIAGGIGITPFISYIREHPILDKRVHFYYSFRGEENAVYLDLLRDYAQKNPNFELHLIDSTKDGYLNFEQKEVPEHATVYMCGPISMMKALAKQIKKQNPKTELIYEGFKFK

SEQ ID NO: 188 - protein, 396 aa, Streptococcus pneumoniae CDC1873-00
MKSVKGLLFIIASFILTLLTWMNTSPQFMIPGLALTSLSLTFILATRLPLLESWFHGLEKVYTVHKFTAFLSIILLIFHNFSMGGLWGSRLAAQFGNLAIYIFASIILVAYLGKYIQYEAWRWIHRLVYLAYILGLFHIYMIMGNRLLTFNLLSFLVGSYALLGLLAGFYIIFLYQKISFPYLGKITHLKRLNHDTREIQIHLSRPFNYQSGQFAFLKIFQEGFESAPHPFSISGGHGQTLYFTVKNSGDHTKNIYDNLQAGSKVTLDRAYGHMIIEEGRENQVWIAGGIGITPFISYIREHPILDKRVHFYYSFRGEENAVYLDLLRDYAQKNPNFELHLIDSTKDGYLNFEQKEVPEHATVYMCGPISMMKALAKQIKKQNPKTVLIYEGFKFK

SEQ ID NO: 189 - protein, 396 aa, Streptococcus pneumoniae SP19-BS75
MKSVKGLLFIIASFILTLLTWMNTSPQFMIPGLALTSLSLTFILATRLPLLESWFHGLEKVYTVHKFTAFLSIILLIFHNFSMGGLWGSRLAAQFGNLAIYIFASIILVAYLGKYIQYEAWRWIHRLVYLAYILGLFHIYMIMGNRLLTFNLLSFLVGSYALLGLLAGFYIIFLYQKISFPYLGKITHLKRLNHDTREIQIHLSRPFNYQSGQFAFLKIFQEGFESAPHPFSISGGHGQTLYFTVKNSGDHTNNIYDNLQAGNKVTLDRAYGHMIIEEGRENQVWIAGGIGITPFISYIREHPILDKQVHFYYSFRGDENAVYLDLLRNYAQKNPNFELHLIDSTKDGYLNFEQKEVPEHATVYMCGPISMMKALAKQIKKQNPKTELIYEGFKFK

SEQ ID NO: 190 - protein, 396 aa, Streptococcus pneumoniae MNZ11b
MKSVKGLLFIIASFILTLLTWMNTSPQFMIPGLALTSLSLTFILATRLPLLESWFHGLEKVYTVHKFTAFLSIILLIFHNFSMGGLWGSRLAAQFGNLAIYIFASIILVAYLGKYIQYEAWRWIHRLVYLAYILGLFHIYMIMGNRLLTFNLLSFLVGSYALLGLLAGFYIIFLYQKISFPYLGKITHLKRLNHDTREIQIHLSRPFNYQSGQFAFLKIFQEGFESAPHPFSISGGHGQTLYFTVKNSGDHTNNIYDNLQAGSKVTLDRAYGHMIIEEGRENQVWIAGGIGITPFISYIREHPILDKQVHFYYSFRGDENAVYLDLLRNYAQKNPNFELHLIDSTKDGCLNFEQKEVPEHATVYMCGPISMMKALAKQIKKQNPKTELIYEGFKFK

SEQ ID NO: 191 - protein, 396 aa, Streptococcus pneumoniae GA47901
MKSVKGLLFIIASFILTLLTWMNTSPQFMIPGLALTSLSLTFILATRLPLLESWFHGLEKVYTVHKFTAFLSIILLIFHNFSMGGLWGSRLAAQFGNLAIYIFASIILVAYLGKYIQYEAWRWIHRLVYLAYILGLFHIYMIMGNRLLTFNLLSFLVGSYALLGLLAGFYIIFLYQKISFPYLGKITHLKRLNHDTREIQIHLSRPFNYQSGQFAFLKIFQEGFESAPHPFSISGGHGQTLYFTVKNSGDHTNNIYDNLQAGSKVTLDRAYGHMIIEEGRENQVWIAGGIGITPFISYIREHPILDKQVHFYYSFRGDENAVYLDLLRNYAQKNPNFELHLIDSTKDGYLNFEQKEVPEHATVYMCGPISMMKALAKQIKKQNPKTELIYEGFKFK

SEQ ID NO: 192 - protein, 397 aa, Streptococcus pneumoniae 2009
MKSVKGLLFIIASFILTLLTWMNTSPQFMIPGLALTSLSLTFILATRLPLLESWFHGLEKVYTVHKFTAFLSIILLIFHNFSMGGLWGSRLAAQFGNLAIYIFASIILVAYLGKYIQYEAWRWIHRLVYLAYILGLFHIYMIMGNRLLTFNLLSFLVGSYALLGLLAGFYIIFLYQKISFPYLGKITHLKRLNHDTREIQIHLSRPFNYQSGQFAFLKIFQEGFESAPHPFSISGGHGQTLYFTVKNSGDHTNNIYDNLQAGSKVTLDRAYGHMIIEEGRENQVWIAGGIGITPFISYIREHPILDKQVHFYYSFRGDENAVYLDLLRNYAQKNPNFELHLIDSTKDGYLNFEQKEVPEHATVYMCGPISMMKHLPNRLRNKIQKQSLFTKDSSSNK

SEQ ID NO: 193 - protein, 396 aa, Streptococcus pneumoniae MNZ14
MKSVKGLLFIIASFILTLLTWMNTSPQFMIPGLALTSLSLTFILATRLPLLESWFHGLEKVYTVHKFTAFLSIILLIFHNFSMGGLWGSRLAAQFGNLAIYIFASIILVAYLGKYIQYEAWRWIHRLVYLAYILGLFHIYMIMGNRLLTFNLLSFLVGSYALLGLLAGFYIIFLYQKISFPYLGKITHLKRLNHDTREIQIHLSRPFNYQSGQFAFLKIFQEGFESAPHPFSISGGHGQTLYFTVKNSGDHTNNIYDNLQAGSKVTLDRAYGHMIIEEGRENQVWIAGGIGITPFISYIREHPILDKRVHFYYSFRGEENAVYLDLLRDYAQKNPNFELHLIDSTKDGYLNFEQKEVPEHATVYMCGPISMMKALAKQIKKQNPKTELIYEGFKFK

SEQ ID NO: 194 - protein, 396 aa, Streptococcus pneumoniae GA41301
MKSVKGLLFIIASFILTLLTWMNTSPQFMIPGLALTSLSLTFILATRLPLLESWFHGLEKVYTVHKFTAFLSIILLIFHNFSMGGLWGSRLAAQFGNLAIYIFASIILVAYLGKYIQYEAWRWIHRLVYLAYILGLFHIYMIMGNRLLTFNLLSFLVGSYALLGLLAGFYIIFLYQKISFPYLGKITHLKRLNHDTREIQIHLSRPFNYQSGQFAFLKIFQEGFESAPHPFSISGGHGQTLYFTVKNSGDHTNNIYDNLQTGSKVTLDRAYGHMIIEEGRENQVWIAGGIGITPFISYIREHPILDKQVHFYYSFRGDENAVYLDLLRNYAQKNPNFELHLIDSTKDGYLNFEQKEVPEHATVYMCGPISMMKALAKQIKKQNPKTELIYEGFKFK

SEQ ID NO: 195 - protein, 396 aa, Streptococcus pneumoniae GA13224
MKSVKGLLFIIASFILTLLTWMNTSPQFMIPGLALTSLSLTFILATRLPLLESWFHGLEKVYTVHKFTAFLSIILLIFHNFSMGGLWGSRLAAQFGNLAIYIFASIILVAYLGKYIQYEAWRWIHRLVYLAYILGLFHIYMIMGNRLLTFNLLSFLVGSYALLGLLAGFYIIFLYQKISFPYLGKITHLKRLNHDTREIQIHLSRPFNYQSGQFAFLKIFQEGFESAPHPFSISGGHGQTLYFTVKTSGDHTKNIYDNLQAGSKVTLDRAYGHMIIEEGRENQVWIAGGIGITPFISYIREHPILDKQVHFYYSFRGDENAVYLDLLRNYAQKNPNFELHLIDSTKDGYLNFEQKEVPEHATVYMCGPISMMKALAKQIKKQNPKTELIYEGFKFK

SEQ ID NO: 196 - protein, 396 aa, Streptococcus pneumoniae GA47368
MKSVKGLLFIIASFILTLLTWMNTSPQFMIPGLALTSLSLTFILATRLPLLESWFHGLEKVYTVHKFTAFLSIILLIFHNFSMGGLWGSRLAAQFGNLAIYIFASIILVAYLGKYIQYEAWRWIHRLVYLAYILGLFHIYMIMGNRLLTFNLLSFLVGSYALLGLLAGFYIIFLYQKISFPYLGKITNLKRLNHDTREIQIHLSRPFNYQAGQFAFLKIFQEGFESAPHPFSISGGHGQTLYFTVKNSGDHTKNIYDNLQVGSKVSVDRAYGHMIIEEGRENQVWIAGGIGITPFISYIREHPILDKQVHFYYSFRGDENAFYLDLLRDYAQKNPNFELHLVDSTKDGYLNFEQEEVPEHASVYMCGPLSMMKSLAKQIKKQNPKTELIYEGFKFK

SEQ ID NO: 197 - protein, 396 aa, Streptococcus pneumoniae BS458
MKSVKGLLFIIASFILTLLTWMNTSPQFMIPGLALTSLSLTFILATRLPLLESWFHGLEKVYTVHKFTAFLSIILLIFHNFSMGGLWGSRLAAQFGNLAIYIFVSIILVAYLGKYIQYEAWRWIHRLVYLAYIFGLFHVYMIMGNRLLTFNLLSFLVGSYALLGLLAGFYIIFLYQKIGFPYLGKITHLKRLNHDTIEIQIHLSRPFNYQSGQFAFLKIFQEGFESAPHPFSISGGHGQTLYLTVKNSGDHTKNIYDNLHVGSKVSVDRAYGHMIIEEGRENQVWIAGGIGITPFISYIREHPILDKQVHFYYSFRGEENAVYLDLLRDYAQKNPNFELHLVDSRKDGYLNFDQEKVPEHASVYMCGPLSMMESLAKQIKKQNPKAELIYEGFKFK

SEQ ID NO: 198 - protein, 396 aa, Streptococcus pneumoniae GA13856
MKSVKGLLFIIASFILTLLTWMNTSPQFMIPGLALTSLSLTFILATRLPLLESWFHSLEKVYTVHKFTAFLSIILLIFHNFSMGGLWGSRLAAQFGNLAIYIFASIILVAYLGKYIQYEAWRWIHRLVYLAYILGLFHIYMIMGNRLLTFNLLSFLVGSYALLGLLAGFYIIFLYQKISFPYLGKITHLKRLNHDTREIQIHLSRPFNYQSGQFAFLKIFQEGFESAPHPFSISGGHGQTLYFTVKNSGDHTKNIYDNLQAGSKVTLDRAYGHMIIEEGRENQVWIAGGIGITPFISYIREHPILDKQVHFYYSFRGDENAVYLDLLRNYAQKNPNFELHLIDSTKDGYLNFEQKEVPEHATVYMCGPISMMKALAKQIKKQNPKTELIYEGFKFK

SEQ ID NO: 199 - protein, 396 aa, Streptococcus pneumoniae GA07643
MKSVKGLLFIIASFILTLLTWMNTSPQFMIPGLALTSLSLTFILATRLPLLESWFHSLEKVYTVHKFTAFLSIILLIFHNFSMGGLWGSRLAAQFGNLAIYIFASIILVAYLGKYIQYEAWRWIHRLVYLAYILGLFHIYMIMGNRLLTFNLLSFLVGSYALLGLLAGFYIIFLYQKISFPYLGKITHLKRLNHDTREIQIHLSRPFNYQSGQFAFLKIFQEGFESAPHPFSISGGHGQTLYFTVKTSGDHTKNIYDNLQAGSKVTLDRAYGHMIIEEGRENQVWIAGGIGITPFISYIREHPILDKQVHFYYSFRGDENAVYLDLLRNYAQKNPNFELHLIDSTKDGYLNFEQKEVPEHATVYMCGPISMMKALAKQIKKQNPKTELIYEGFKFK

SEQ ID NO: 200 - protein, 397 aa, Streptococcus pneumoniae 3051
MKSVKGLLFIIASFILTLLTWMNTSPQFMIPGLALTSLSLTFILATRLPLLESWFHSLEKVYTVHKFTAFLSIILLIFHNFSMGGLWGSRLAAQFGNLAIYIFASIILVAYLGKYIQYEAWRWIHRLVYLAYILGLFHIYMIMGNRLLTFNLLSFLVGSYALLGLLAGFYIIFLYQKISFPYLGKITHLKRLNHDTREIQIHLSRPFNYQSGQFAFLKIFQEGFESAPHPFSISGGHGQTLYFTVKTSGDHTKNIYDNLQAGSKVTLDRAYGHMIIEEGRENQVWIAGGIGITPFISYIREHPILDKQVHFYYSFRGDENAVYLDLLRNYAQKNPNFELHLIDSTKDGYLNFEQKEVPEHATVYMCGPISMMKHLPNRLRNKIQKQSLFTKDSSSNK

SEQ ID NO: 201 - protein, 304 aa, Streptococcus pneumoniae 2070335
MKSVKGLLFIIASFILTLLTWMNTSPQFMIPGLALTSLSLTFILATRLPLLESWFHSLEKVYTVHKFTAFLSIILLIFHNFSMGGLWGSRLAAQFGNLAIYIFASIILVAYLGKYIQYEAWRWIHRLVYLAYILGLFHIYMIMGNRLLTFNLLSFLVGSYALLGLLAGFYIIFLYQKISFPYLGKITHLKRLNHDTREIQIHLSRPFNYQSGQFAFLKIFQEGFESAPHPFSISGGHGQTLYFTVKTSGDHTKNIYDNLQAGSKVTLDRAYGHMIIEEGRENQVWIAGGIGITPSSLTSVNILF

SEQ ID NO: 202 - protein, 396 aa, Streptococcus pneumoniae GA58981
MKSVKGLLFIIASFILTLLTWMNTSPQFMIPGLALTSLSLTFILATRLPLLESWFHSLEKVYTVHKFTAFLSIILLIFHNFSMGGLWGSRLAAQFGNLAIYIFASIILVAYLGKYIQYEAWRWIHRLVYLAYILGLFHIYMIMGNRLLTFNLLSFLVSSYALLGLLAGFYIIFLYQKISFPYLGKITHLKRLNHDTREIQIHLSRPFNYQSGQFAFLKIFQEGFESAPHPFSISGGHGQTLYFTVKNSGDHTKNIYDNLQAGSKVTLDRAYGHMIIEEGRENQVWIAGGIGITPFISYIREHPILDKQVHFYYSFRGDENAVYLDLLRNYAQKNPNFELHLIDSTKDGYLNFEQKEVPEHATVYMCGPISMMKALAKQIKKQNPKTELIYEGFKFK

SEQ ID NO: 203 - protein, 313 aa, Streptococcus salivarius CCHSS3
MKSYKGILLLIASLGLTVYAWLATGMTNFVAPGLALTTLSWTFMLATRSRVLEKLFNGIESMYAVHKFLAILSIVLLVFHNIGMGSLWGSRLAGQLGNLGIYTFLAIVVLAFLGKHLKYETWRWLHRLVYLAYIFGLSHVYLILGQVLTKLSLLSLVVGVFAILGLSSGFYIIFLYQIIGFKNRGKIVGLERINHDTTEIAIKLTRPMDYQFGQFAFIKILQASFEKSPHPFSISGGHGNIIYFTVKASGDHTKQIYKKLRVGSPVAIDRAYGHMLLNQGRDKQVWIAGGIGITPFISYIRENPVLDRDVDFY

SEQ ID NO: 204 - protein, 397 aa, Streptococcus vestibularis F0396
MKSYKGILLLTISVVLTVYAWLARGMTNLVAPGLALTTLSWTFMLATRSRVLEKVFNGIERMYTVHKFLAILSVVLLVFHNIGMGSLWGSRLAAQLGNLGIYTFLAIVVLVFLGKTLKYETWRWLHRLVYLAYIFGLSHVYLILGQVLTKPSLLSFVVGGFAILGLSSGFYIIFLYQIIGFKNRGKIVGLKRINHDTTEIAIRLTRPMDYQFGQFTFIKILQAGFEKAPHPFSISGGHGNIIYFTVKASGDHTKQIYKKLRVGSPVAIDRAYGHMLLDQGRDKQVWIAGGIGITPFISYIRENPVLDRDIDFYYAYTGEQNAVYLEMLTAYAAKNKHFKLHTVNSQVDGYLDFTDYPLTDDTTVFMCAPVKMMEAFAKTFTANNPKAELVYEGFSFK

SEQ ID NO: 205 - protein, 397 aa, Streptococcus vestibularis ATCC 49124
MKSYKGILLLTVSVVLTVYAWLARGMTNFVAPGLALTTLSWTFMLATRSRVLEKVFNGIERMYTVHKFLAILSVVLLVFHNIGMGSLWGSRLAARLGNLGIYTFLAIVVLVFLGKTLKYETWRWLHRLVYLAYIFGLSHVYLILGQVLTKPSLLSLVVGGFAILGLSSGFYIIFLYQIIGFKNRGKIVGLKRINHDTTEIAIRLTRPMDYQFGQFTFIKILQAGFEKAPHPFSISGGHGNIIYFTVKASGDHTKQIYKKLRVGNPVAIDRAYGHMLLDQGRDKQVWIAGGIGITPFISYIRENPVLDRNVDFYYAYTGEQNAVYLERLAAYAAKNRNFKLHTINSQVDGYLDFTDYPLTDDTTVFMCGPVKMMEAFAKTFTANNPKAELVYEGFSFK

SEQ ID NO: 206 - protein, 444 aa, Rubrivivax gelatinosus 100245
MKTIRTTFVALAAGLSALWLAAEASALPAAQGVFPWRNLLVQYSGVLGMGLMSVGMLLALRPAWLDERLHGMDKGYRLHKWLGIAGLALSVAHWLFAKGPKWLVQAGWLERPQRGPRPQFEPDSLLALLQGLRHPAEEIGEYAFYAMLALIAIALIKRFPYRRFFQTHRAMALVYLVLVFHSVVLTKPEYWLQPVGLVLAALMAVGTVSAFMSLARRIGRARRVEGRVESVEFQPGTQVTAVTVQLGEGWRGHDAGQFAFVTFDAAEGAHPFTIASAWAGDGRLRFLIKALGDYTRTLPQALKAGDAVAVEGPYGRFRFEGEQRRQVWIGAGIGVTPFVARLQALARRPDGRTIDMFHPTAAVDPVALARLEADAGAAGVRLHVLQDGRDGRLDATRLRQLVPDWLHADFWFCGPAAFGEALKRDLAAAGLPAGRFHQELFEMR

SEQ ID NO: 207 - protein, 444 aa, Rubrivivax benzoatilyticus JA2
MKTIRTTFVALAAGLSVLWLAAEASALAAAQGVFPWRNLLVQCSGVLGMGLMSAGMLLALRPAWLDERLHGLDKGYRLHKWLGIAGLVLSVAHWLFAKGPKWLVQAGWLERPQRGPRPQLEPDSLLALMQGLRHPAEEIGEYAFYVMLALIAIALIKRFPYRRFFQTHRAMALVYLVLVFHSVVLTKAEYWLQPVGLVLAALMAVGTVSAFMSLARRIGRARRVEGRVESVEFLPGTQVTAVTVKLADGWRGHDAGQFAFVTFDAAEGAHPFTIASAWAGDGRLRFLIKALGDYTRTLPQALKAGDAVAVEGPYGRFRFEGRQRRQVWIGAGIGVTPFVARLQALARHPDGRTIDMFHPTAAVDATALARLAADAGAAGVRLHVLQDARDGRLDAARLRQLVPDWLHADFWFCGPAAFGEALKRDLAAAGLPPGRFHQELFEMR

SEQ ID NO: 208 - protein, 439 aa, Aromatoleum aromaticum EbN1
MKTLLASFLALVTVAWAVTSSSNPAEGASLPWVVRQEALYLTGLWAFSLMSLAIMLATRPAWLERPLGGMDRIYRVHKWAGILAIGFAALHWLVEMSDGVIKSVVGREGRLPKEHEGGFLEVMRDVGEDFGEWAIYALIAMLVLTLWKRLPYRPWRYLHHAMPGLYGMLAIHAAFLAPLDYWTSAIGALLALFIAVGTVSGLRSLSGRIGRGRQVSGDIEAVREQASGLTEVVCRLEDRWRGHRPGQFAFVTFDHIEGAHPFTIACADRGDRHITFQIKALGDYTQGLAARLAAGQPVKIEGPYGRFDYRRGRRKSDQVWIAGGIGVTPFLAWLESLQEAPAEAPVADFYYCTRQRDDDPFVARLESLCAALPTIRLHVVSTDRDRPLTAEALHARHAGERQPEIWFCGPRAFAQSLRSGLRDLGMKRVRFHQEAFEMR

SEQ ID NO: 209 - protein, 438 aa, Vibrio ichthyoenteri ATCC 700023
MKTLYLAVIGLITVVLAVWLQAKPELLSYSQFMPWRSSLIQATGIIALVLLTLTMLLALRLTWIERLTAGLDKSYRLHKWVAIWAVIFGTAHWLLAIVPKTLVQLGVIERGNHALPELDPESLQALIMSLRGGAESIGELALYGFILLTLIALLAPIKYKYFKLTHKAMAVAFIVIAYHSVILIKPSYWDNLITPMVIAFALIGTACAVVSLLGLIGKRRTHQGVISALTYNPENQTTKVTMALPTWSGHHAGQFAFLKVAGEEPHPFTISSNSNASHLEFTIKALGDFTSTVHQQLFVGEQVSVEGPYGKFQFDDNRAQIWIAGGIGIAAFKARLAEIKQQDTLPSVTLFYCTQVPSSEFIHELETLAREANIEFHVIDNRIVQHLTIANIKQQFGHLDDHSVWFCGPLGFGEALKAQLRNEQFDLNHFHTELFNFR

SEQ ID NO: 210 - protein, 444 aa, Achromobacter xylosoxidans AXX-A
MKTRSALGLFLLALTGAWAIDALLLQPASGAAWPWALRQQALYLTGVWSIGLMSLIMLLALRPAWLEGPLGGMDKIYRLHKWAGILAIGAGAAHWLIKLASTPLKALVGIEGRPARDAVLAMLADSRGLAKDLGEWTIYALLAMLVITLWRRFPYHAWRIVHRAMPLAFLVLAFHTLALAPTYYWTGPTGALLLPLMAGGAAAALLSLAGRIGQGRRVAGKVTGLVRRPGDILEVTCELGPRWPGHAAGQFAFVTFDRREGAHPFTIASAPHAGRHDVTFQIKALGDFTRRLAATLREGAPVTVEGPYGRFERPADPAAGPQVWVAGGIGVTPFLAWLEAARDAPGDRPPVWLHYCVRDAGADPFVEVLRQRCEALDNVTLQVHSAAQGQRLEAASLAQGEVAAGRVADVWYCGPAGLAAALRQGLRRLGRGGVHWHQEAFDMR

SEQ ID NO: 211 - protein, 441 aa, Achromobacter xylosoxidans NH44784-1996
MKTRTALGLFLLALTGAWAIDALVLQPAATAAWPWVLRQQALYLTGVWSIGLMSLIMLLALRPAWLEGPLGGMDKIYRLHKWAGILAIGAGAAHWLVKLASTPLKALVGVEGRPARDAVLAMLADSRGLAKDLGEWTIYALLAMLVITLWRRFPYHAWRIVHRAMPLAYLILVFHTLALAPAYYWTGPTGALLLPLMAGGAWAALLSLAGRIGRARRVAGRVTALTQRPGDILEVTCELGARWPGHAAGQFAFVTFDRREGAHPFTIASAPHRGRRDVTFQIKALGDYTQRLAATLREGAPVMVEGPYGRFERPAAGPQVWVAGGIGVTPFLAWLEAARDASGHTPPVWLHYCVRDGETDPFVDVLRQRCAALDNVTLQVHSAAAGQRLDAAALAQGEVAAGRVADVWYCGPAGLANALRKGLRRLGRGNVHWHQEAFDMR

SEQ ID NO: 212 - protein, 417 aa, Pseudomonas fluorescens ATCC BAA-477
MKTWHTLVGILLITTATLLLEIPSATWLTSATLSMILGTAALAYMAMSCLLASRWGWVERLFGGLDRVYEAHKWLGIWALAFASYHLVFKANLDEWNSVPILELSKYWTRLVRQLSYVALGLIVLLALNRNIPYSQWRWWHKLSGPLFLIVILHWLSFKSPITLDSPSGIWLALLCVLGVLGALYKLLLYPLVAKAGEYQVTAVRVEKNSLHLELIPQGRGFPFKAGQFAFLSMQEKGLREPHPFTIASAQAHDGRIEFVIRALGDYTQRLRRQVKVGMRADIYAPYGRFKRPQAAAREIWIGGGVGISPFISWLQDEAAGQFDKATLVYCYNPSRAFPSVDTLQGMAQARGVNFVANCGGTEPLAQTLKRTAAETDPQQIQVSFCGPKGLLGQVRELMSECRIPQGNLHYEFFEFR

SEQ ID NO: 213 - protein, 417 aa, Pseudomonas protegens CHA0
MKTWHTLVGILLITTVTLLLEIPSATWLTSATLSMILGTAALAYMAMSCLLASRWGWVERLFGGLDRVYEAHKWLGIWALAFASYHLVFKANLDEWNSVPILELSKYWTRLVRQLSYVALGLIVLLALNRNIPYSQWRWWHKLSGPLFLIVILHWLSFKSPITLDSPSGIWLALLCVLGVLGALYKLLLYPLVAKAGEYQVTAVRVEKNSLHLELIPQGRGFPFKAGQFAFLSMQEKGLREPHPFTIASAQAHDGRIEFVIRALGDYTQRLRRQVKVGMRADIYAPYGRFKRPQAAAREIWIGGGVGISPFISWLQDEAAGQFDKATLVYCYNPSRAFPSVDTLQGMAQARGVNFVANCGGTEPLAQTLKRTAAETDPQQIQVSFCGPKGLLGQVRELMSECRIPQGNLHYEFFEFR

SEQ ID NO: 214 - protein, 417 aa, Pseudomonas sp. GM17
MKTWYSVVGVLLITTLTVLLEIPSDTWLTSATLSLVLGATALAYMALSCLLASRWRWVERLFGGLDRVYESHKWLGIWALLFASYHLVFKANLDLWQSVPIIELSKYWTRMVRQLSYVALGLIVLLALNRNIPYGQWRWWHKLSGPLFAIVILHWLSFKSPIALDNPSGIWLTALCGLGLLGALYKLLLYPLLAKAGEYRVSAVTLEKNSLHLELTPLHRGFAFKAGQFAFLAMREKGLREPHPFTIASAHASDGRIEFVIRALGDYTQKLRQQVKVGMLADLYAPYGRFKRRLDAGREIWIGGGVGISPFISWLQDAAAGRFDQATLVYCCNPSRAFPSLETLQGLAEQRGVAFIGHTDGADRLGETLQRLASETDPQQIQISFCGPKGLLARVKTLMREYAIPERNLHYEFFEFR

SEQ ID NO: 215 - protein, 417 aa, Pseudomonas chlororaphis O6
MKTWYSVVGVLLITTLTVLLEIPSDTWLTSATLSLVLGATALAYMALSCLLASRWRWVERLFGGLDRVYESHKWLGIWALVFASYHLVFKANLDLWQSVPIIELSKYWTRMVRQLSYVALGLIVLLALNRNIPYGQWRWWHKLSGPLFAIVILHWLSFKSPIALDNPSGIWLTALCGLGLLGALYKLLLYPLLAKAGEYRVSAVTLEKNSLHLELTPLHRGFAFKAGQFAFLAMREKGLREPHPFTIASAHASDGRIEFVIRALGDYTQKLRQQVKVGMLADLYAPYGRFKRRLDAGREIWIGGGVGISPFISWLQDAAAGRFDRATLVYCCNPSRAFPSIETLQGLAEERGVDFIGHTDGADRLGETLKRLASETDPQQIQISFCGPKGLLARVKALMREYAIPERNLHYEFFEFR

SEQ ID NO: 216 - protein, 462 aa, Synechocystis sp. PCC 7509
MLEILLVSASTIKEKMRSLLVRNPIAIGVFWVIVYLVIVLLPLLILLLYPPAANVGRGFWLDFSVALGFIGLAMMAMQFALTARIRLIEASYGIDLILQFHRYTSVVAFLFILVHPIILFIDNPKTLQLLNFFHAPWRARAAVIATLALILMVVTSIGRKRLKIPYEPWCMAHGILATVSVGFGLSHALGVGHYLGLFWERTVWIGIVLITLWLLVYVRLVKPLFMLRKPYLVEAVIPQRGDVWNLVLQPRGHVGIHFQPGQFAWITLQISPFRMREHPFSIVSSAERPERIEFGIKAVGDFTKTIKDVAPGTKAFVDGPYGVFMTDRYEDSAGFVFIAGGIGITPILSMLVTLADRHDERPLHLIYGSKTWGNITYRQELSALTDKLDLTIVYVLRNPPKDWSGETGYIDKQLLQRYLPKRPATRNYFICAVPKMMDQIELALHESGVPVTHVHLEHFNLV

SEQ ID NO: 217 - protein, 446 aa, Streptococcus agalactiae MRI Z1-039
MLFSEIFKFCISILWYFILTKNKGVVVMRAWKGIVLILSSIVVTLVAWQNAGLSEFVVPGLALTSLSLTFLLSTKFRILESYFQGIENMYFYHKVMAVFSMILLLLHKIGLGQGGHGSEFAKTIGSAGLYLFLSIVFVAYFGNFLKYEIWRFIHRFVYLAYILGLVHTFMILGDRILGNTLLSLIVLGYAVIGVISGFYIIFLYSRMRFRRVGYVQKVTHLNHDTTEIEIAMKRPYRYDYGQFTFLKIYQAGFESAAHPFSISGGHDRVIFLTVKASGDYTKSIYKQLKVGTKIALDRAYGHMLFDKDKKEQVWIAGGIGITPFISFIRENSILTKRVDFFYTFSNQDNLIYQDMLESYAKANPNFKLHLNNSSLKGRLDFSQSVFEGQPTIFMCGPTSMTSTYAKVFRQKDAKSRLVYEGFSFRDSWLSIFLLKTFDKVYSNLIK

SEQ ID NO: 218 - protein, 446 aa, Streptococcus agalactiae serotype III NEM316
MLFSEIFKFCISILWYFILTKNKGVVVMRAWKGIVLILSSIVVTLVAWQNAGLSEFVVPGLALTSLSLTFLLSTKFRILESYFQGIENMYFYHKVMAVFSMILLLLHKIGLGQGGHGSEFAKTIGSAGLYLFLSIVFVAYFGNFLKYEIWRFIHRFVYLVYILGLVHTFLILGDRILGNTLLSLIVLGYAVIGVISGFYIIFLYSRMRFRRVGYVQKVTHLNHDTTEIEIAMKRPYRYDYGQFTFLKIYQAGFESAAHPFSISGGHDRVIFLTVKASGDYTKSIYKQLKVGTKIALDRAYGHMLFDKDKKEQVWIAGGIGITPFISFIRENSILTKRVDFFYTFSNQDNLIYQDMLESYAKANPNFKLHLNNSSLQGRLDFSQSVFEGQPTIFMCGPTSMTSTYAKVFRQKDAKSRLVYEGFSFRDSWLSIFLLKTFDKVYSNLIK

SEQ ID NO: 219 - protein, 398 aa, Comamonas testosteroni ATCC 11996
MLLTGILALGAMTAIMVLALRPRWVESPLGGMDKAYRLHKWLGIIAITLSLAHWLAKQSKPLIATAIGSTGRLAKVPVPEWVSLLKPYAKTLGEWTFYALILMLVITLARRSVPYKRWYWFHRFMPLAYLILVFHGIVLTPPGYWSGVGGWLLALTMALGVVAAAMQLVRDLRSRYPHAGTVLSFTQLGDVLELQCRMDDSWPGHAAGQFAFLRLAGEQEAHPFTLSDADQQDHVVRFHIKQLGDWTRSLPKRLQPGIVVELDGPYGRFVPPDHDDGAVHVWVGAGVGATPFLSWLGQLHHDGHAPQAWLQYACQHAVDPLAQALKEAAALHPDVHLDIFADGHRWTPKEVLQRYRADKPLRVWFCGPAAMGEQLELTLKQSLPADSWQLHREHFEFR

SEQ ID NO: 220 - protein, 429 aa, Vibrio sp. HENC-03
MLNFGIVFVALLIPYSVLQIGTPTLEWPMFWQVRTYLVNYSGIVSMILMSLCVILSVKHWPLERWLGGLDKQYRLHKYLGISAVFSALFHWGAFLSDDFAMDFGYIEPKNETFPFWKLIDALGDQAQLIGEYGFYLSAAFVLIAWIKKFKHNVFQLTHKVFPYLYLLLVLHMVMFFDASLWLIVTGAILLLVSGLATVGCLITILDLNGKKKRYPAKVSSIKSIKDGIEVVLKVEAHQFTYQPGQFAFIGFDDKERPHPFSLASAHNENGQVRLLIKANGDYTRSLMETLKVGQSAQIEGPYGCFNFQDDTEQQIWFAAGIGIAPFLTAIEAVGTAKSVTLFYSYREEDKVLLDELQRRAQGSGVKLYMRNTSEEGRFTNTEIIGRITNVEHSSVWFCGPSELGKKLEKAFTNIGLPAKSFHRELFEFR

SEQ ID NO: 221 - protein, 429 aa, Vibrio harveyi CAIM 1792
MLNFGVVLITLLVPYAVLQIGTPTLEWSLFWQVRTYLVNYSGIVSMLLMSLCVILSVKHWPLECWLGGLDKQYRLHKYLGISAVFSALFHWGAFLSDDFAMDFGFVEPKDETFPFWKLIDAMGDPAQLIGEYGFYLSAAFVLIAWIKKFKHNVFQLTHKVLPYLYLFLVLHMVMFFEAGLWITPSGAFLLCVSGLATVGCFMTIFNLNGKKKCHDAKVQSIKPISNGIEVMLKVDSAEFVYQPGQFAFVDFGDNERPHPFSLASAYHQNGEVRLMIKANGDYTSALKGSLKVGQAARIEGPYGRFNFQDNAERQVWFAAGIGIAPFLTAIETVGTSKTVYLFYSYREEDKPLLEELKQRAKKAGVTLYTKNTSVQGRFRNAEVTECVEGTRHCSVWYCGPSELGKTLEKAFVRLGLPAKSFHRELFELR

SEQ ID NO: 222 - protein, 429 aa, Vibrio sp. HENC-01
MLNFGVVLITLLVPYAVLQIGTPTLEWSLFWQVRTYLVNYSGIVSMLLMSLCVILSVKHWPLERWLGGLDKQYRLHKYLGISAVFSALFHWGAFLSDDFAMDFGFVEPKDETFPFWKLIDAMGDPAQLIGEYGFYLSAAFVLIAWIKKFKHNVFQLTHKVLPYLYLFLVLHMVMFFEASLWLTPSGAILLCVSGLATVGCFMTIFNLNGKKKCHDAKVQSIKPISNGIEVMLKVDSAEFVYQPGQFAFVDFGDNERPHPFSLASAYHQNGEVRLMIKANGDYTSALKGSLKVGQAARIEGPYGRFNFQDNAERQVWFAAGIGIAPFLTAIETVGTSKTVYLFYSYREEDKPLLEELKQRAKKAGVTLYTKNTSVQGRFRNAEVTECVEGTRHCSVWYCGPSELGKTLEKAFVRLGLPAKSFHRELFELR

SEQ ID NO: 223 - protein, 451 aa, Escherichia coli KTE10
MLRCQNEIKKMKKANLTGTLVCFVACIIFLSSRDIFREKPIALIWFIRQNTLFFTGTLAWCLMTLTMCLSLRSSWLNKVLGGLDKAWRLHKWAGICAIAFTFAHWLDEKLPQLFVAFGWLTHPGKIVDINLTPVQENWLHAGLLAGECAMFIMIAMVFVSLSKKVPYHLFHLVHRLFPVFYLAIAFHVFTALFKSYWWETPAAYLLILITIPGVFAAFISLLKLNGNKNKHQATIKSIVNHPGQITEVILELEHAIDYSPGQFAFLTFAHSKESHPFTIASYAIEKNTLRFAIKNLGDYTSTLASSIKIGQSALVEGPWGKFDFTLPCSRQVWIAGGIGITPFIAQLEYLNQHGASRVPVDLWYCVSRSEDAWYVDKLTSLCAQASVTLHLLDAHKGERLQSHYLTDKIANKGDTHFWFCGPQSFAKALSKGLYENGIASQNFHYDRFCMR

SEQ ID NO: 224 - protein, 431 aa, Lactobacillus mali KCTC 3596
MLRKIQYKLVLFWLSFFFVVPLPFIQTISAGLQGMAANEMLAIYSGVIAYAWMLAAVYLSTKPRWLDRLVGLPSIYQLHGIIAIAALGLAWLHKLGTHSAGLIKQTGDLALIILTGLIGYSLLFLAGWLISRFSLLSKFKKILEKVFKHEVTMLLHKLLLAAVILVFIHVQLIDYIRSITSFMIWFDGLSLLTALSYLKTKINWHGRKGQAELKLIQNHSLSARVRELTFGGRQSQQLNLQAGDFVFLSFPHISKLREPHPFSLVSLPDKNGKFKLTIRADGDFTDRLKTLKAGVTAKVTGGFGRYQAFIAEHDCTSNLVIITGGIGVTPLFSLIPNNLSHKIYLFYSAHHQTDLLYQHQLNQWNQHTNFTGFWQQGRFSDDFVLNHLPNDWQNHTLFLLSGPIPLIHHWEKLLGKTKVSSKNIFKEEFNW

SEQ ID NO: 225 - protein, 396 aa, Dehalobacter sp. UNSWDHB
MLVCFAWVNFISTRHPLLDSLFHGLDKSYLYHKALSIISVLLIFVHRFTLDAGKGNHYGENRANLGPGPNGLNGPPPGAENGAEFFSGIANLSMLLFIVLILLALFVWKTNYEKWKNIHKLFFIPYMIGIIHYYGSSDYAVTGLSALGLWLNLVNLVGLTSAIYSIGFYERTAFQPRYVVTNIRTVAKDTLEITGKALKKGIRYKEGQFTFIKFTEEGKKFPSHPFTISQSFRKNEIQFAIKALGDHTSALLENVQEGDTFAVTSSHGRFDYKAGSNRQVWLAGGIGITPFRSFYQSAIPPQYSIDLFYCYNNEAEGPYLDEIKTLAAGSGIRVHLHDLQTKGFLDAEDICEAVPKTETVDVYFCGPEPMRIKLERELKTCGLRIGHFHYESFQFK

SEQ ID NO: 226 - protein, 423 aa, Ralstonia sp. PBA
MMHLTGPLLATLATLYAALLGAQTYAAYGLETALGMALGAASIAAMSLALLLSIRPRWAEPFFGGLDRMYGLHKWLGIAALALMLGHNTLEPELEGVVRETRLGEFAADVGEVALNGFIGLILLSWIKRIPFTRLELPWPVWRLTHRFTGLLFAVAAFHQFAVDKPAGVDTTLGLYLNVLCAAGLAAWLYTQLLAPLLRPRGFVLESIDRYDAVTELKLRPEGRAMRWRPGQFAFVTTPGAGLADAHPFTIAGAPDASGSLRFDIKALGGWTRRLPQRLAPGQHLRIEGPYGRFVFRKRVQRQVWLAGGIGITPFLAWAEALRASDQQEIVLVWAVTSRAEAFVAARLADLAAGHPGLTVHIVASSESGRLTAARLVSLVPFALRDCELFYCGPTGLRETIVAGLEALAQRPRRIHYEAFELR

SEQ ID NO: 227 - protein, 438 aa, Marinobacter sp. ES-1
MMRMIFPFVVLVLGLWAWNLFAGPGAGSPWAVYDQSLLLSGLLSIALMSLAMMLALRPAWLERPLGGLDQIYRTHKWAGILAVVFAAAHWLIEMGDDVIESVFGKAGKLHDQDYSGFIDTMRDAAEEVGEFAIYLLFAMLLITLLRKFPYKYWRYLHRGMPVLYLLLAFHAAWLTPLQWWQQPIGVLMAILLFGGSIASGLSLTGRVGRRRQVRGMVTAIKTPDRDVTEVTCHMGPAWPGHRAGQFAFVTFDRLEGAHPFTIASADRENGTVTFIIKSLGDFTRNLSQKISVGQTVNIEGPYGCFNFDRRNRKSHQIWIAGGIGITPFLAWLEALSSATDATVPEADLHYCTRNAGQDPMVDRLRALCDGFPGIHLEIHDSSKGQRLSAETLSTNGRSAAGAEVWFCGPAGLGEAIRNGLRAAPFRLTRFHKEAFQFR

SEQ ID NO: 228 - protein, 438 aa, Vibrio sp. N418
MNKLYLTVLGLVATGMLIWLQAEPTIFSNTNFMQWRSSLIQGTGIIALLLLTLTMLLALRLPWIEKLTAGLDKSYRLHKWVAIWGAILGAAHWLLAIVPKKLVQLGLLERGNHARPELDPDSLQATVAGLRGGAESIGEIALYGFILLTLIALIAPIKYKHFKLTHKAMAVAFIMIAYHSVVLLKPSYWDNLITPMVITFALIGTACAVVCLLGLIGKGRTHQGAISAFTYNPENQTTKVAIALPTWSGHHAGQFAFLKVAGEEPHPFTISSSADAPQLEFTIKALGDFTATLHQRLKVGEKVAVEGPYGKFQFDDNRAQIWVAGGIGIAAFKARLAERQKDQNTTPVTLYYCTQAPSSIFIHEIETLARKANIEFHVIDNRIRQHLTIADITQQQGPLDNHSVWFCGPLGFGEALKSQLSNEEFDLKHFHTELFNFR

SEQ ID NO: 229 - protein, 438 aa, Vibrio scophthalmi LMG 19158
MNKLYLTVLGLVATGMLIWLQAEPTIFSNTNFMQWRSSLIQGTGIIGLLLLTLTMLLALRLPWIEKLTAGLDKSYRLHKWVAIWGVILGAAHWLLAIVPKKLVQLGLLERGNHARPELDPDSLQATVMSLRGGAESIGEIALYGFILLTLIALFAPIKYKHFKLTHKAMAVAFIVIAYHSVVLLKPSYWDNLITPMVIAFALIGTACAVVSLLGLIGKRRTHQGVISALTYNTENQTTKVAIALPTWSGHQAGQFAFLKVAGEEPHPFTISSSADAPQLEFTIKALGDFTATLHQRLTVGEKVTVEGPYGKFQFDDNRAQIWVAGGIGIAAFKARLAERQKDQNTTPVTLYYCTQAPSSIFIHEIETLARKANIEFHVIDNRIRQHLTIADITQQQGPLDNHSVWFCGPLGFGEALKSQLSREQFDLKHFHTELFNFR

SEQ ID NO: 230 - protein, 390 aa, Escherichia coli KTE24
MNMMISYQELVRTFLNKVLGGLDKAWRLHKWAGICAIAFAFAHWLDEKLPQLFVAFGWLTHPGKIVDINLTPVQENWLHAGLLAGECAMFIIIAMVCVSLSKRVPYHLFHLVHRLFPVFYLAIAFHVFTALFKSYWWETPAAYLLILITIPGVFAAFISLLKLNGSKNKHQATIKNIVNHPGQITEVTLELEHAIDYSPGQFAFLTFAHSKESHPFTIASYTKEKNTLRFAIKNLGDYTSTLASSIKIGQSAFVEGPWGKFDFTLPCSHQVWIAGGIGITPFIAQLEYRKHHGASSVPVDLWYCVSRSEDAWYVDKLTSLCAQARVTLHLLDAHKGERLQAHYLTDKIANKGDTHFWFCGPQSFAKALSKGLYENGIASQNFHYDRFCMR

SEQ ID NO: 231 - protein, 430 aa, Thioalkalivibrio sp. K90mix
MNRLHRGDFLLLLALLVPLWAGGHLAPIIWERDEVIRWLTQVSGVLALTSMLLAGILSIRLPHSDRLFGGLIDLWRRHHALGAASLLLAIAHVWLVAAGGLGHSVASAVHRLFPGPDHWPILAGWAALIVLVIVLAPTFKFFGEPGYARWKRLHAFSGLALLLGIVHAWPLAQATWPWWVLGLLALAAYLWRKLLSPRIGRYTYRVERLDRLTSSMVELCLRPEEKPLDYHPAQFVYLTPLDPGLANGQGEEHPFTIASAPGEEHLRIGIKALGDGSRALQEIAPGSPIQVEGPYGTFLQGHNRKRQAVWLGAGVGITPFVSAVRALAREGRSANPPVHLFQLADRREAAAYHDELERLANTIEDLDLTLHLRERDGLLNADFLRQHGADFASAEFWVCGPGVVDRYVRGLLHAEGVPNSRIHSEAFHLL

SEQ ID NO: 232 - protein, 335 aa, Vibrio harveyi 1DA3
MNRNLMLNFGIVFVALLIPYSVLQIGTPTLEWPMFWQVRTYLVNYSGIVSMTLMSLCVILSVKHWPLERWLGGLDKQYRLHKYLGISAVFSALFHWVAFLSDDFAMDFGCVEPKNETFPFWKLIDALGDQAQLIGEYGFYLSAAFVLIAWINKFKHNVFQLTHKVFPYLYLLLVLHMVMFFDASLWLTVTGAILLLVSGFATVGCLITILGLNGKTKRYPAKVSSIKSMNGGIEVVLKVLEPQFKYQPGQFAFIGFDDKERPHPFSLASAHSDNGQVRLLIKANGDYTRSLMETLEVGQSAQIEGPYGCFNFQDETEQQIWFAAGIGIAPIFNRN

SEQ ID NO: 233 - protein, 436 aa, Wohlfahrtiimonas chitiniclastica SH04
MNRQRLMILGIITLALLVWGIDLYQHPITWSGMVLRKQLIYLSGLMAFLFMGLILVLSIRPRCLERWFGGLDQMYALHKWAGIFAIGFAVFHYLIKLGKPVFAYLFGAGAGKGPKPELFGFEAWLKSFSGIAKDLGEYLVYFLMVMLVITLWQKFSYKIWRHLHRLMAPVFIVLAFHSLVLMPFFYWTQPVGMLIVLVSVVGSMAAVWAMLGKIGAGVRHQGTIIAIKHHHGIIDVTCQLPKSFHHQAGQFAFLRTSALEGAHPFTLSCADQGNGQVRLTIKDLGDYTHSLMTNLHVGDTVTVEGPYGCFQYNDQSPQVWVAGGIGITPFMAWLEAMVNNPKIRPEVDFYYCVKAPHEAIDVAHIEALIHQLPNVRFHLHISDEAGFLTMDKIAAHTPQAKAVWFCGPQPFAESLRKDLPKHLPKATFHQERFNFR

SEQ ID NO: 234 - protein, 443 aa, Vibrio cholerae serotype O1 ATCC 39541
MNRVKYTLWVMVGIVTLLWVQAEPTLFGSTNLFQWRSGLVQFSGILALMLMSLAMLLALRLPSVERWTRGIDKGYRIHKWIGISALLLGILHWLAYQIPKWLISLELLTKPARLNGSGPNSNLSGLALWLKEAKPLAMEIGEWGFYALIVLLVVSLWSAIKYKPFRLTHRLMAVVYLLIALHSVILLKKAYWGEPIYWLTMLFIVVGSWAACYSLLGLVGRQSRYPAHVKAFHYCPNSQTLDLTIQLDKPWLGHKAGQFAYLKFAGEEPHPFTIACAHQGSQLRFLIKELGDFTTGLHQRLQNGESLEVEGPYGKFDFSTQQPQIWIGGGVGIAPFMAGLDWLMRERAHPPVHLFFCCHQIDPDLCAELRHKAQLAGVSLTIIDSSVDPHLSADDIARRCGDLSRFEIYFCGPIAFSNSLKKALKPYQVDLSRQFHEEQFVMR

SEQ ID NO: 235 - protein, 443 aa, Vibrio cholerae MZO-3
MNRVKYTLWVMVGIVTLLWVQAEPTLFGSTNLFQWRSGLVQFSGILALMLMSLAMLLALRLPSVERWTRGIDKGYRIHKWIGISALLMGILHWLAYQIPKWLISLELLTKPARLNGSGPNSNLSGLALWLKEAKPLAMEIGEWGFYALIVLLVVSLWSAIKYKPFRLTHRLMAVVYLLIALHSVILLKKAYWGEPIYWLTMLFIVVGSWAACYSLLGLVGRQSRYPAHVKAFHYCPNSQTLDLTIQLDKPWLGHKAGQFAYLKFAGEEPHPFTIACAHQGSQLRFLIKELGDFTTGLHQRLQNGESLEVEGPYGKFDFSTQQPQIWIGGGVGIAPFMAGLDWLMTERAHPPVHLFFCCHQIDPNLCAELRHKAQLAGVSLTIIDSSVDPHLSADDIARRCGDLSRFEIYFCGPIAFSNSLKKALKPYQVDLSRQFHEEQFVMR

SEQ ID NO: 236 - protein, 433 aa, Bifidobacterium animalis subsp. lactis BB-12
MPMKRIAIRRFPIQAVLVWAAALVVVPMPFTAIPWATLGPMYRSMLTPITAGIYAYIWMLECVWLGCRPRWLDRIIGLPGIYVLHGVLGTGALALVVYHQYVLPSFGPAKTTGEIAFWTLVGIVALALVMMAGWLDTLVPPLATVRSWLERVFRHEFTVWLHRIVLVAVVLACLHFNLVFYIKDLTAFIVTMDVTTGLVLAWYAWVKLRDRMFAARGKVVSARRVSNDIVEILVDCPAMHSWEYGDFVFLRLPRERGMHGSHPFSIANLPGEHGDAMRFAVRINGDFTERLYRTARAGMRVDVIGPFGMYERFIARHDAHAPIVVYAGGVGITPIIPTIMALSGTNRPVTVMYTAKRADDLLYADELRKWSASEAHTPHMQVGRWSKTELAEQITDGAIYLIAGPSGMIRDVRRMLLRHGVPGSRMFYEPFTR

SEQ ID NO: 237 - protein, 428 aa, Marinobacter sp. BSs20148
MPNLRTSVVLFLLLAAQLSVWTAGLSYELLLTLSGYFAINFMSITMLLATRPGWLESPLGGLDRMYQLHKWTGIMAVSFALAHWLIEMADDALEALFGSDRSLKEAHLSGLLDSLQDGAEDLGEPGLYLLVFLVVITLIRWVPFGYWRYLHRVMPLIYLALAAHALLLAPLLWWQQPTGWLMALLIVGGATASLQSLTGKIGRSHRYKGLVQDVKQTSANITEVVCDMGKRWPGHRAGQFALVTFDRVEGAHPFSLSCADNATGQLSFQIKALGDYTRKIPQKLHSGQAVTLEGPYGRFDLDRGRKSAQQTWVAGGIGITPFLAALDNRLINNEKRHPAVTLHYCTAGAVNDPMVTRLQQLTEQLPDISLHIYDSLEGQRLTANQLQIHAPKVDVWFCGPQGLAKALRSGLKQQSVSVRFHQENFEFR

SEQ ID NO: 238 - protein, 444 aa, Rhodopseudomonas palustris BisB5
MQFMRLTATFALVVLGLAALWALSLAPGALSQGFWATRTTLVYGTGVMALGLMSVGIILAARPVWFETPLGGLDKFYRLHKWLGLSALGFALAHWVLRKGPSWITELGLFAIPPKPPHAKDVPTGFDVFRDLRDFAAEIGEWALYLLVALVALALWKRFPYKYFFKTHRLMPMVYLVLVFHAFILIDRSYWTQPLGPVLALLLAAGTLAALIALFRKIGSGRQASGKIATLRLYEGNQVLDVGVRLETAWRGHEAGQFAFVNFDDIEDAHPFTISSTWQNDGMLLFTIKGLGDYTRSLAGSLRLGQGVVVEGPYGRFDFHGDAGRQIWIGGGVGVTPFIARLRDLARVGRSEPVDLFYATNVPDTAFIAPIRQLALQTGISFHLVDGSQDGRLTLESLAATVPDWKQADIWFCGPSGFGDAMRGAMIAQGLPKARFHQELFEMR

SEQ ID NO: 239 - protein, 298 aa, Vibrio cholerae HC-56A2
MQFSGILALMLMSLAMLLALRLPLIEQWTQGIDKGYRIHKWLGISALLLGIFHWLAYHLPKWLISLELLTKPARLNGSGPNSNLSGLALWLKEAKPLAMEIGEWGFYALIVLLVVSLWSAIKYKPFRLTHRLMAVVYLLIALHSVILLKKAYWGEPIYWLTMLFIVVGSWAACYSLLGLVGRQSRYPAHVKAFHYCPNSQTLDLTIQLDKPWLGHKAGQFAYLKFAGEEPHPFTIACAHQGSQLRFLIKELGDFTTGLHQRLQNGKSLEVEGPYGKFDFSTQQPQIWIGGGVGIAPFM

SEQ ID NO: 240 - protein, 404 aa, Vibrio mimicus MB451
MQFSGILALMLMSLAMLLALRLPLIEQWTQGIDKGYRIHKWLGISALLLGIFHWLAYHVTKWLISLELLTKPARLNGSGPHGNLSGLALWLKEAKPLAMEIGEWGFYALIGLLAISLWSAIKYKPFRFTHRMMAVVYLAVAFHAIALLKKAYWGEPIYWLTLLFTLVGSWAALYSLLGLVGRQSRYPAHVEAFHYCSQSKTLDLTIQLDKPWQGHKAGQFAYLRFSGEEPHPFTIACAHHGSQLRFLIKELGDFTTGLHERLQNGESLEVEGPYGKFDFAANQPQIWIGGGVGIAPFMAGLDWLTMERSHPQVHLFFCCHQIDPNLCAELRHKAQLAGVSLSIIDSSVDPHLSADDIARRCGDLSRFEIYFCGPIAFSNSLKKALKPYRVDLSRQFHEEQFVMR

SEQ ID NO: 241 - protein, 404 aa, Vibrio cholerae NHCC-008D
MQFSGILALMLMSLAMLLALRLPSVEGWTCGIDKGYRIHKWIGISALLLGILHWLAYQIPKWLISLELLTKPARLNGSGPNSNLSGLALWLKEAKPLAMEIGEWGFYALIVLLVVSLWSAIKYKPFRLTHRLMAVVYLLIALHSVILLKNAYWGEPIYWLTMLFIVVGSWAACYSLLGLVGRQSRYPAHVEAFHYCPNSQTLDLTIQLDKPWLGHKAGQFAYLKFAGEEPHPFTIACAHQGSQLRFLIKELGDFTTGLHQRLQNGESLEVEAPYGKFDFSTHQPQIWIGGGVGIAPFMAGLDWLMTERAHPPVHLFFCCHQIDPNLCAELRHKAQLAGVSLTIIDSSVDPHLSADDIARRCGDLSRFEIYFCGPIAFSNSLKKALKPYQVDLSCQFHEEQFVMR

SEQ ID NO: 242 - protein, 404 aa, Vibrio cholerae HE-25
MQFSGILALMLMSLAMLLALRLPSVERWTRGIDKGYRIHKWIGISALLLGILHWFAYQIPKWLISLELLTKPARLNGSGPNSNLSGLALWLKEAKPLAMEIGEWGFYALILLLVVSLWSAIKYKPFRLTHRLMAVVYLLIALHSVILLKKAYWGEPIYWLTMLFIVVGSWAACYSLLGLVGRQSRYPAHVKAFHYCPNSQTLDLTIQLDKPWLGHKAGQFAYLKFAGEEPHPFTIACAHQGSQLRFLIKELGDFTTGLHQRLQNGKSLEVEGPYGKFDFSTQQPQIWIGGGVGIAPFMAGLDWLMRERAHPPVHLFFCCHQIDPNLCAELRHKAQLAGVSLTIIDSSVDPHLSADDIARRCGDLSRFEIYFCGPIAFSNSLKKALKPYQVDLSRQFHEEQFVMR

SEQ ID NO: 243 - protein, 404 aa, Vibrio cholerae 623-39
MQFSGILALMLMSLAMLLALRLPSVERWTRGIDKGYRIHKWIGISALLLGILHWLAYQIPKWLISLELLTKPARLNGSGPNSNLSGLALWLKEAKPLAMEIGEWGFYALILLLVVSLWSAIKYKPFRLTHRLMAVVYLLIALHSVILLKKAYWGEPIYWLTMLFIVVGSWAVCYSLLGLVGRQSRYPAHVKAFHYCPNSQTLDLTIQLDKPWLGHKAGQFAYLKFAGEEPHPFTIACAHQGSQLRFLIKELGDFTTGLHQRLQNGKSLEVEGPYGKFDFSTQQPQIWIGGGVGIAPFMAGLDWLMTERAHPPVHLFFCCHQIDPDLCAELRHKAQLAGVSLTIIDSSVDPHLSADDIARRCGDLSRFEIYFCGPIAFSNSLKKALKPYQVDLSRQFHEEQFVMR

SEQ ID NO: 244 - protein, 404 aa, Vibrio cholerae TMA 21
MQFSGILALMLMSLAMLLALRLPSVERWTRGIDKGYRIHKWIGISALLLGILHWLAYQIPKWLISLELLTKPARLNGSGPNSNLSGLALWLKEAKPLAMEIGEWGFYALIVLLVVSLWSAIKYKPFRLTHRLMAVVYLLIALHSVILLKKAYWGEPIYWLTMLFIVVGSWAACYSLLGLVGRQSRYPAHVKAFHYCPNSQTLDLTIQLDKPWLGHKAGQFAYLKFAGEEPHPFTIACAHQGSQLRFLIKELGDFTTGLHQRLQNGESLEVEGPYGKFDFSTPQPQIWIGGGVGIAPFMAGLDWLMTERAHPPVHLFFCCHQIDPNLCAELRHKAQLAGVSLTIIDSSVDPHLSADDIARRCGDLSRFEIYFCGPIAFSNSLKKALKPYQVDLSRQFHEEQFVMR

SEQ ID NO: 245 - protein, 404 aa, Vibrio cholerae 95412
MQFSGILALMLMSLAMLLALRLPSVERWTRGIDKGYRIHKWIGISALLLGILHWLAYQIPKWLISLELLTKPARLNGSGPNSNLSGLALWLKEAKPLAMEIGEWGFYALIVLLVVSLWSAIKYKPFRLTHRLMAVVYLLIALHSVILLKKAYWGEPIYWLTMLFIVVGSWAACYSLLGLVGRQSRYPAHVKAFHYCPNSQTLDLTIQLDKPWLGHKAGQFAYLKFAGEEPHPFTIACAHQGSQLRFLIKELGDFTTGLHQRLQNGESLEVEGPYGKFDFSTQQPQIWIGGGVGIAPFMAGLDWLMRERAHPPVHLFFCCHQIDPDLCAELRHKAQLAGVSLTIIDSSVDPHLSADDIARRCGDLSRFEIYFCGPIAFSNSLKKALKPYQVDLSRQFHEEQFVMR

SEQ ID NO: 246 - protein, 404 aa, Vibrio cholerae CP1037
MQFSGILALMLMSLAMLLALRLPSVERWTRGIDKGYRIHKWIGISALLLGILHWLAYQIPKWLISLELLTKPARLNGSGPNSNLSGLALWLKEAKPLAMEIGEWGFYALIVLLVVSLWSAIKYKPFRLTHRLMAVVYLLIALHSVILLKKAYWGEPIYWLTMLFIVVGSWAACYSLLGLVGRQSRYPAHVKAFHYCPNSQTLDLTIQLDKPWLGHKAGQFAYLKFAGEEPHPFTIACAHQGSQLRFLIKELGDFTTGLHQRLQNGESLEVEGPYGKFDFSTQQPQIWIGGGVGIAPFMAGLDWLMTERAHPPVHLFFCCHQIDPNLCAELRHKAQLAGVSLTIIDSSVDPHLSADDIARRYGDLSRFEIYFCGPIAFSNSLKKALKPYQVDLSRQFHEEQFVMR

SEQ ID NO: 247 - protein, 404 aa, Vibrio cholerae HE48
MQFSGILALMLMSLAMLLALRLPSVERWTRGIDKGYRIHKWIGISALLLGIWHWLAYQIPKWLISLELLTKPARLNGSGPNSNLSGLALWLKEAKPLAMEIGEWGFYALIVLLVVSLWSAIKYKPFRLTHRLMAVVYLLIALHSVILLKKAYWGEPIYWLTMLFIVVGSWAACYSLLGLVGRQSRYPAHVEAFHYCPNSQTLDLTIQLDKPWLGHKAGQFAYLKFAGEEPHPFTIACAHQGSQLRFLIKELGDFTTGLHQRLQNGESLEVEGPYGKFDFSTQQPQIWIGGGVGIAPFMAGLDWLMTERAHPPVHLFFCCHQIDPNLCAELRHKAQLAGVSLTIIDSSVDPHLSADDIARRCGDLSRFEIYFCGPIAFSNSLKKALKPYQVDLSRQFHEEQFVMR

SEQ ID NO: 248 - protein, 404 aa, Vibrio cholerae BJG-01
MQFSGILALMLMSLAMLLALRLSSVERWTRGIDKGYRIHKWIGISALLLGILHWLAYQIPKWLISLELLTKPARLNGSGPNSNLSGLALWLKEAKPLAMEIGEWGFYALIVLLVVSLWSAIKYKPFRLTHRLMAVVYLLIALHSVILLKKAYWDEPIYWLTMLFIVVGSWAACYSLLGLVGRQSRYPAHVEAFHYCPNSQTLDLTIQLDKPWLGHKAGQFAYLKFAGEEPHPFTIACAHQGSQLRFLIKELGDFTTGLHQRLQNGESLEVEGPYGKFDFSTQQPQIWIGGGVGIAPFMAGLDWLMTERAHPPVHLFFCCHQIDPNLCAELRHKAQLAGVSLTIIDSSVDPHLSADDIARRCGDLSRFEIYFCGPIAFSNSLKKALKPYQVDLSRQFHEEQFVMR

SEQ ID NO: 249 - protein, 404 aa, Vibrio cholerae HC-02A1
MQFSGILALMLMSLAMLLALRLTSVERWTRGIDKGYRIHKWIGISALLLGILHWLAYQIPKWLISLELLTKPARLNGSGPNSNLSGLALWLKEAKPLAMEIGEWGFYALILLLVVSLWSAIKYKPFRLTHRLMAVVYLLIALHSVILLKKAYWGEPIYWLTMLFIVVGSWAACYSLLGLVGRQSRYPAHVKAFHYCPNSQTLDLTIQLDKPWLGHKAGQFAYLKFAGEEPHPFTIACAHQGSQLRFLIKELGDFTTGLHQRLQNGKSLEVEGPYGKFDFSTQQPQIWIGGGVGIAPFMAGLDWLMTERAHPPVHLFFCCHQIDPNLCAELRHKAQLAGVSLTIIDSSVDPHLSADDIARRCGDLSRFEIYFCGPIAFSNSLKKALKPYQVDLSRQFHEEQFVMR

SEQ ID NO: 250 - protein, 404 aa, Vibrio cholerae HC-43B1
MQFSGILALMLMSLAMLLALRLTSVERWTRGIDKGYRIHKWIGISALLLGILHWLAYQIPKWLISLELLTKPARLNGSGPNSNLSGLALWLKEAKPLAMEIGEWGFYALIVLLVVSLWSAIKYKPFRLTHRLMAVVYLLIALHSVILLKKAYWGEPIYWLTMLFIVVGSWAACYSLLGLVGRQSRYPAHVEAFHYCPNSQTLDLTIQLDKPWLGHKAGQFAYLKFAGEEPHPFTIACAHQGSQLRFLIKELGDFTTGLHQRLQNGESLEVEGPYGKFDFSTQQPQIWIGGGVGIAPFMAGLDWLMTERAHPPVHLFFCCHQIDPNLCAELRHKAQLAGVSLTIIDSSVDPHLSADDIARRCGDLSRFEIYFCGPIAFSNSLKKALKPYQVDLSRQFHEEQFVMR

SEQ ID NO: 251 - protein, 404 aa, Vibrio cholerae EM-1676A
MQFSGILALMLMSLSMLLALRLPLIEQWTQGIDKGYRIHKWLGISALLLGIFHWLAYHLPKWLISLELLTKPARLNGSGPHGNLSGLALWLKEAKPLAMEIGEWGFYALIGLLAISLWSAIKYKPFRFTHRMMAVVYLAVAFHAIVLLKKAYWGEPIYWLTLLFILVGSWAALYSLLGLVGRQSRYPAHVEAFHYCSQSKTLDLTIQLDKPWRGHKAGQFAYLKFAGEEPHPFTIACAHQGSQLRFLIKELGDFTTGLHQRLQNGKSLEVEGPYGKFDFSTQQPQIWIGGGVGIAPFMAGLDWLMRERAHPPVHLFFCCHQIDPDLCAELRHKAQLAGVSLTIIDSSVDPHLSADDIARRCGDLSRFEIYFCGPIAFSNSLKKALKPYQVDLSRQFHEEQFVMR

SEQ ID NO: 252 - protein, 421 aa, Rhodopseudomonas palustris BisA53
MQPQIATLRALSIPLLSLAVPLGFAWWAFPTGLAPLRAAGIITGWIGCGLLLVSLLLMLREPRLANWLGGLERMYRWHHATGVVAYVALLAHPLLLAANGLSTSTVFAWETLSAFDQGWPVWSGWLGLLVLMAGLAVAFGRRLPYGIWRWLHAGLAIGVLLGLVHLVLLGIDEPVLPIIAVVALILGWRLLRGDLGLAAHPYIVAEVSPLAEAAVEIALRPLGTALSIAPGQFVLVAFYAGPTYRGCGEFHPFTVSSIDRNEVVRIGVKALGDCTRRMLSMEANVAARVIGGFGSFLGDRAVTPQLWVGGGIGVTPFVGLLRAGPLKTDTTLLYLYRTEAEAAFLAELRGFAAADAKFSLQAVATGDALPALDRLLPDKAQLSGTDCYLCGPPGLIAALTTMLRARGVDAHHIHFENFEFR

SEQ ID NO: 253 - protein, 444 aa, Rhodopseudomonas palustris BisA53
MQQTRLTTVYALAILGLLGLWFLSLEPGAFAQGFWATRTTLVYGTGVLALGLMSVGVILAARPVWFEPALGGLDKFYRLHKWLGIAAFGFAIAHWVLRKGPSWITDLSLFAIPPKPPHAKDVAIGFDLFRDLKHPAAEIGEWAFYCLIALVALALWKRFPYKYFFKTHRLMPVVYLVLVFHAFILIDRSYWTMPLGPVLALLLTAGTIAALISLFEKIGTSRRASGTIATLSLYDGNQVLDVDVRLATAWPGHDAGQFAFVNFDDAEAAHPFTITSAWHNDGLLKFSIKGLGDYTRTLASSLHVGQGVVVEGPYGRFNFQGEGARQIWIGGGVGITPFIARLRQLAEVVRSDPIDLFYATNSPDTAFIAPIRRLAQQTGIAFHLVDGSHDDRLTFEKLATMVPDWKQADVWFCGPAGFGDAMRGKMIAQGLPASRFHQEMFEMR

SEQ ID NO: 254 - protein, 440 aa, Pseudomonas stutzeri KOS6
MQRIKAACLALLAGLSLLWWLANDFTTGSYSRFWPLRADMVQYTGVLAIAAMSGAMLLAIRPRRIERLFDGLDKTYRLHKWLGIAALALGVVHWGWAQVPKWLVGLGWLERPLRAGAEQARSGLAAWQHSQRGLAEDIGEWAFYSAVVLLKRIPYRWFFRTHRWLALVYLALVIHSLILMQPAYWRSALGPVMALLLLAGSLAGLVSLARRIGRRRQVIGHIHALHHHADNHVLRVDITLDGPWPGHQAGQFAFVTFDEREGPHPFSLSSAWCNDGKLAFAIKGLGDYTRTLPERLSVGDPVRVEGPYGCFDFKGRKRSQIWVAGGIGIAPFIARLQALANGSADGGGNVDLFYSTNAPDQDFIERIRQLAERAHVRLHLMIASEHGRLTPERLRQQIPHWLDCDFWFCGPSGFARDLRRGLQAHGLAQGDFHQELFNMR

SEQ ID NO: 255 - protein, 445 aa, Leptolyngbya sp. PCC 6406
MQRLFMHNPIAVATLWIVTYIGVSLFPLAVILLYPAPLDRGFWLEFSVALGFMGLAMMVLQFALTARVNRIEASYGIDILLQFHRYTSLAAFLMVLVHPVILFVVDPETLGLLNFFEAPWRARMAVMATLAFLTMVVTTIWRKPLNIPYEPWRAAHSLLAVVAVGFGFGHALGVSNYMGLFWKGVLWSAMGLVALWLMLYVRLVKPMLMTKRPYLVEAVEPQRGDVWTLALRPHGHEGFTFQPGQFAWLTLGIHPIGMREHPFSMSSSGDHPERLEFGIKALGDFTRSIKDVKPGTKAYLDGPYGVFTTERYWDSAGFVLIAGGIGITPMYSMLLTAVERQDDRPFLLIYSASSWEDFTYREELEVLKDNIDLTIIYVPRHPHEGWTGETGYVNKQLLARYIPLHRGSRHYFICAAPVMMDGVEAALFDLEVPVTHVHMEHFNLA

SEQ ID NO: 256 - protein, 445 aa, Oscillatoria acuminata PCC 6304
MQRLLMRSPVAVAAFWIALYIAIALLPLLVLILHAPPEARDFWTEFSVALGFIGLAMIALQFALTARINRIESSYGIDIILQFHRYISLVAFTLIIIHPLILFINEPETLELLNVFQAPWRARFAVTGTVALIILVITSVWRQRLGIPYEEWRIAHGILAVCAVGFGIAHAVGVGYYLNFFWKVVLWSAVGFLALLLLIYVRLVKPWLMTRKLYLVEEVIPQRGDVWTLALRPRGHEGITFEPGQFAWITLEISPFRMREHPFSMSSSGDHAERLEFSIKALGDFTKTIKDVKPGTKAFLDGPYGTFTIDKYWDAAGFVLVAGGIGITPMMSMLVTACERKDDRPFLLIYGSKTWDDITFREELEALKDELDLKIVHVLREPPEDWDGETGYVDQELLEKYMPTHAGSRQYFICASPKMMDQVEAAFYELDVPVTHVHMEHFNLV

SEQ ID NO: 257 - protein, 444 aa, Rhodopseudomonas palustris HaA2
MQTPRVATAFVGAVGILLGLWLLSLAPDDFRQGFWATRTTLVYGTGVMALGLMSIGVILAARPVWFETPLGGLDKFYRLHKWLGISVLGFAIAHWLLRKGPSWISETGLFAIPPKPPHAEGVEPGFNLFAYLKHPAAEIGEWALYALIALVAIALWKRFPYKYFFMTHRLMPAVYLVLVFHAFILIDRSYWTKPLGPVLAVLLLAGTVAALTSLFGRIGRSRKATGAIATLSLHDDNQMLEVGVRLQTAWRGHEAGQFAFVDFDDVEAAHPFTITSAWHDDGLLEFSIKGLGDYTRTLAASLHVGQGVVVEGPYGRFDFQGDGSRQIWIGGGVGITPFIARLKQLVRVGRSDPIDLFYATNTPDSGFIAPIRRLAQQTGTVFHLVDGSQNDRLTVEKLAAMVPEWKQADIWFCGPSAFGDAMRRTMITQGLPASRFHQELFEMR

SEQ ID NO: 258 - protein, 445 aa, Rhodopseudomonas palustris TCC BAA-98
MQTVRLKVAFAGVIGGLSGLWLLSLAPDAWQQGFWETRATLVYGCGVLALGLMSVGVILAARPVWFETPLGGLDKFYRLHRWLGISALGFALVHWLLREGPSWITELGLVALPPKPAHPQEDAALGFDLFRDLKHPAAEVGEWALYALVVLVAIALWKRFPYKYFFWTHRLMPLVYLALVFHAFILIDKSYWTKPLGPVLACLLIAGTVAAVIALFRRIGSSRKASGTIATLSLYDDNQMLEVGVRLETAWRGHEAGQFAFVDFDDAEAAHPFTISSSWQNDGLLMFSIKGLGDYTRSLAGSLHVGQGVVVEGPYGRFNFEDDSGRQIWIGGGVGVTPFIARLKQLVGGGQSNPVDLFYATDTPDPGFVAPIAQLARQSGIAFHVVDGSQGDRLTLEKLAALVPEWKQADVWFCGPSGFGDAMRRAMMAQGLPASRFHQESFEMR

SEQ ID NO: 259 - protein, 445 aa, Rhodopseudomonas palustris TIE-1
MQTVRLKVAFAGVIGGLSGLWLLSLAPDAWQQGFWETRATLVYGCGVLALGLMSVGVILAARPVWFETPLGGLDKFYRLHRWLGISALGFALVHWLLREGPSWITELGLVALPPKPAHPQEDAALGFDLFRDLKHPAAEVGEWALYALVVLVAIALWKRFPYKYFFWTHRLMPLVYLALVFHAFILIDKSYWTKPLGPVLACLLIAGTVAAVIALFRRIGSSRKASGTIATLSLYDDNQMLEVGVRLETAWRGHEAGQFAFVDFDDAEAAHPFTISSSWQNEGLLMFSIKGLGDYTRSLAGSLHVGQGVVVEGPYGRFNFEDDSGRQIWIGGGVGVTPFIARLKQLVGGGQSNPVDLFYATDTPDPGFVAPIAQLARQSGIAFHVVDGSQGDRLTLEKLAALVPEWKQADVWFCGPSGFGDAMRRAMMAQGLPASRFHQESFEMR

SEQ ID NO: 260 - protein, 419 aa, Streptococcus agalactiae GB00640
MRALKGIVLILSSIVVTLVAWQNAGLSEFVVPGLALTSLSLTFLLSTKFRILESYFQGIENMYFYHKVMAVFSMILLLLHKIGLGQGGHGSEFAKTIGSAGLYLFLSIVFVAYFGNFLKYEIWRFIHRFVYLAYILGLVHTFMILGDRILGNTLLSLIVLGYAVIGVISGFYIIFLYSRMRFRRVGYVQKVTHLNHDTTEIEIAMKRPYRYDYGQFTFLKIYQAGFESAAHPFSISGGHDRVIFLTVKASGDYTKSIYKQLKVGTKIALDRAYGHMLFDKDKKEQVWIAGGIGITPFISFIRENSILTKRVDFFYTFSNQDNLIYQDMLESYAKANPNFKLHLNNSSLQGRLDFSQSVFEGQPTIFMCGPTSMTSTYAKVFRQKDAKSRLVYEGFSFRDSWLSIFLLKTFDKVYSNLIK

SEQ ID NO: 261 - protein, 445 aa, Anaeromyxobacter dehalogenans 2CP-C
MRAVRLQDLTRVGLWIALYVLLALYPLLWLAAVPAPGGGDFRQELAAALGFLGLSIMAMQFLLTARFQWLAPPFGTDVVYAFHRHVTAVALVFVAAHPLVLLGPELGVGGMAAWLLPWRAPGAVGAGVWSLYALVVLAVTSYGRRRLRLPYEAWRVLHGVAATAAVLLGLWHAAAARRLLAGPVTRVMWIAWTLAWVALLLRVRVAKPLALRARPYRVSEVRPERGDAVTLVLDPDGHEGFRFRAGQFAWLALGASPFAAREHPFSISGSSQRAPRVELTVKALGDFTRRVQATRPGARAWVDGPYGTMSVDAFPDADGYLFVAGGIGIAPCLSMLRTLADRGDRRPHQLVFGTGRWERTPFREALAELATRLDLTVVHVLEHPPDGWTGEVGVVGEDVLRRHLPRGHRGCFVCGPPAMMDAVEKALVRLGVPLRDVHSERFDLV

SEQ ID NO: 262 - protein, 444 aa, Anaeromyxobacter sp. K
MRAVRLQDLTRVGLWIALYVLLALYPLLWLAAVPAPGGGGDLRQELAAALGFLGLSIMAMQFLLTARFQWLAPPFGTDVVYAFHRHVTAVALAFLLLHPLVLLGPGLGGLAEWLLPWRAPGPVGAGVWSLYALLVLAVTSYGRRRLRLPYEAWRVLHGAAATAAVLLGLWHAAAARRLLAGPVTRVMWIAWTLAWVALLLRVRVAKPLALRARPYRVSEVRPERGDAVTLVLDPDGHEGFRFRAGQFAWLTLGASPFAAREHPFSISGSSQRAPRVELTVKALGDFTQRVQATRPGARAWVDGPYGTMSVDAFPDADGYLFVAGGIGVAPCLSMLRTLADRGDRRPHQLVFGTGRWERTPFREALAELATRLDLTVVHVLEHPPDGWTGEVGVVGEDVLRRHLPRGHRGCFVCGPPAMMDAVETALVRLGVPLRDIHSERFDLV

SEQ ID NO: 263 - protein, 444 aa, Anaeromyxobacter dehalogenans BAA-258
MRAVRLQDLTRVGLWIALYVLLALYPLLWLAAVPAPGGGGDLRQELAAALGYLGLSIMAMQFLLTARFQWLAPPFGTDVVYAFHRHVTAVALLFLLLHPLVLLGPGLGGMAEWLVPWRAPGPVAAGVWSLYALLVLAVTSYGRRRLRLPYEAWRALHGVAATAAVLLGLWHAAAARRLLAGPVTRVMWIAWTLAWVALLLRVRIAKPLALRARPYRVREVRPERGDAVTLVLDPEGHEGFRFRAGQFAWLTLGASPFAAREHPFSISGSSQRAPRVELTVKALGDFTRRVQATRPGARAWVDGPYGTMSVDAFPDADGYLFVAGGIGIAPCLSMLRTLADRGDRRPHQLVFGTGRWERTPFREALAELATRLDLTVVHVLEHPPDGWTGEVGVVGEDVLRRHLPRGHRGCLVCGPPAMMDAVETALVRLGVPLRDIHSERFDLV

SEQ ID NO: 264 - protein, 419 aa, Streptococcus agalactiae FSL S3-026
MRAWKGIVLILSSIAVTLVAWQNAGLSEFVVPGLALTSLSLTFLLSTKFRILESYFQGIENMYFYHKVMAVFSMILLLLHKIGLGQGGHGSEFAKTIGSAGLYLFLSIVFVAYFGNFLKYEIWRFIHRFVYLAYILGLVHTFMILGDRILGNTLLSLIVLGYAVIGVISGFYIIFLYSRMRFRRVGYVQKVTHLNHDTTEIEITMKRPYRYDYGQFTFLKIYQAGFESAAHPFSISGGHDRVIFLTVKASGDYTKSIYKQLKVGTKIALDRAYGHMLFDKDKKEQVWIAGGIGITPFISFIRENSILTKRVDFFYTFSNQDNLIYQDMLESYAKANPNFKLHLNNSSLQGRLDFSQSVFEGQPTIFMCGPTSMTSTYAKVFRQKDAKSRLVYEGFSFRDSWLSIFLLKTFDKVYSNLIK

SEQ ID NO: 265 - protein, 419 aa, Streptococcus agalactiae GB00865
MRAWKGIVLILSSIVVTLVAWQNAGLSEFVVPGLALTSLSLTFLLSTKFRILESYFQGIENMYFYHKVMAVFSMILLLLHKIGLGQGGHGSDFAKTIGSAGLYLFLSIVFVAYFGNFLKYEIWRFIHRFVYLAYILGLVHTFMILGDRILGNTLLSLIVLGYAVIGVISGFYIIFLYSRMRFRRVGYVQKVTHLNHDTTEIEIAMKRPYRYDYGQFTFFKIYQAGFESAAHPFSISGGHDRVIFLTVKASGDYTKSIYKQLKVGTKIALDRAYGHMLFDKDKKEQVWIAGGIGITPFISFIRENSILTKRVDFFYTFSNQDNLIYQDMLESYAKANPNFKLHLNNSSLKGRLDFSQSVFEGQPTIFMCGPTSMTSTYAKVFRQKDAKSRLVYEGFSFRDSWLSIFLLKTFDKVYSNLIK

SEQ ID NO: 266 - protein, 419 aa, Streptococcus agalactiae ILRI005
MRAWKGIVLILSSIVVTLVAWQNAGLSEFVVPGLALTSLSLTFLLSTKFRILESYFQGIENMYFYHKVMAVFSMILLLLHKIGLGQGGHGSEFAKTIGSAGLYLFLSIIFVAYFGNFLKYEIWRFIHRFVYLAYILGLVHTFMILGDRILGNTLLSLIVLGYAVIGVISGFYIIFLYSRMRFRRVGYVQKVTHLNHDTTEIEIAMKRPYRYDYGQFTFLKIYQVGFESAAHPFSISGGHDRVIFLTVKASGDYTKSIYKQLKVGTKIALDRAYGHMLFDKDKKEQVWIAGGIGITPFISFIRENSILTKRVDFFYTFSNQDNLIYQDMLESYAKANPNFKLHLNNSSLQGRLDFSQSVFEGQPTIFMCGPTSMTSTYAKVFRQKDAKSRLVYEGFSFRDSWLSIFLLKTFDKVYSNLIK

SEQ ID NO: 267 - protein, 419 aa, Streptococcus agalactiae FSL S3-337
MRAWKGIVLILSSIVVTLVAWQNAGLSEFVVPGLALTSLSLTFLLSTKFRILESYFQGIENMYFYHKVMAVFSMILLLLHKIGLGQGGHGSEFAKTIGSAGLYLFLSIVFVAYFGNFLKYEIWRFIHRFVYLAYILGLVHTFMILGDRILGNTLLSLIVLGYAVIGVISGFYIIFLYSRMRFRRVGYVQKVTHLNHDTTEIEIAMKRPYRYDYGQFTFFKIYQAGFESAAHPFSISGGHDRVIFLTVKASGDYTKSIYKQLKVGTKIALDRAYGHMLFDKDKKEQVWIAGGIGITPFISFIRENSILTKRVDFFYTFSNQDNLIYQDMLESYAKANPNFKLHLNNSSLKGRLDFSQSVFEGQPTIFMCGPTSMTSTYAKVFRQKDAKSRLVYEGFSFRDSWLSIFLLKTFDKVYSNLIK

SEQ ID NO: 268 - protein, 419 aa, Streptococcus agalactiae CCUG 39096
MRAWKGIVLILSSIVVTLVAWQNAGLSEFVVPGLALTSLSLTFLLSTKFRILESYFQGIENMYFYHKVMAVFSMILLLLHKIGLGQGGHGSEFAKTIGSAGLYLFLSIVFVAYFGNFLKYEIWRFIHRFVYLAYILGLVHTFMILGDRILGNTLLSLIVLGYAVIGVISGFYIIFLYSRMRFRRVGYVQKVTHLNHDTTEIEIAMKRPYRYDYGQFTFLKIYQAGFESAAHPFSISGGHDRVIFLTVKASGDYTKSIYKQLKVGTKIALDRAYGHMLFDKDKKEQVWIAGGIGITPFISFIRENSILTKRVDFFYTFSNQDNLIYQDMLESYAKANPNFKLHLNNSSLKGRLDFSQSVFEGQPTIFMCGPASMTSTYAKVFRQKDAKSRLVYEGFSFRDSWLSIFLLKTFDKVYSNLIK

SEQ ID NO: 269 - protein, 419 aa, Streptococcus agalactiae ZQ0910
MRAWKGIVLILSSIVVTLVAWQNAGLSEFVVPGLALTSLSLTFLLSTKFRILESYFQGIENMYFYHKVMAVFSMILLLLHKIGLGQGGHGSEFAKTIGSAGLYLFLSIVFVAYFGNFLKYEIWRFIHRFVYLAYILGLVHTFMILGDRILGNTLLSLIVLGYAVIGVISGFYIIFLYSRMRFRRVGYVQKVTHLNHDTTEIEIAMKRPYRYDYGQFTFLKIYQAGFESAAHPFSISGGHDRVIFLTVKASGDYTKSIYKQLKVGTKIALDRAYGHMLFDKDKKEQVWIAGGIGITPFISFIRENSILTKRVDFFYTFSNQDNLIYQDMLESYAKANPNFKLHLNNSSLKGRLDFSQSVFEGQPTIFMCGPTSMTSTYAKVFRQKDAKSRLVYEGFSFRDSWLSIFLLKTFDKVYSNLIK

SEQ ID NO: 270 - protein, 419 aa, Streptococcus agalactiae BSU247
MRAWKGIVLILSSIVVTLVAWQNAGLSEFVVPGLALTSLSLTFLLSTKFRILESYFQGIENMYFYHKVMAVFSMILLLLHKIGLGQGGHGSEFAKTIGSAGLYLFLSIVFVAYFGNFLKYEIWRFIHRFVYLAYILGLVHTFMILGDRILGNTLLSLIVLGYAVIGVISGFYIIFLYSRMRFRRVGYVQKVTHLNHDTTEIEIAMKRPYRYDYGQFTFLKIYQAGFESAAHPFSISGGHDRVIFLTVKASGDYTKSIYKQLKVGTKIALDRAYGHMLFDKDKKEQVWIAGGIGITPFISFIRENSILTKRVDFFYTFSNQDNLIYQDMLESYAKANPNFKLHLNNSSLQGRLDFSQSVFEGQPTIFMCGPTSMTSTYAKVFRQKDAKSRLVYEGFSFRDSWLSIFLLKTFDKVYSNLIK

SEQ ID NO: 271 - protein, 311 aa, Streptococcus agalactiae BSU450
MRAWKGIVLILSSIVVTLVAWQNAGLSEFVVPGLALTSLSLTFLLSTKFRILESYFQGIENMYFYHKVMAVFSMILLLLHKIGLGQGGHGSEFAKTIGSAGLYLFLSIVFVAYFGNFLKYEIWRFIHRFVYLAYILGLVHTFMILGDRILGNTLLSLIVLGYAVIGVISGFYIIFLYSRMRFRRVGYVQKVTHLNHDTTEIEIAMKRPYRYDYGQFTFLKIYQAGFESAAHPFSISGGHDRVIFLTVKASGDYTKSIYKQLKVGTKIALDRAYGHMLFDKDKKEQVWIAGGIGITPFISFIRLPAKQNMVQ

SEQ ID NO: 272 - protein, 419 aa, Streptococcus agalactiae ILRI112
MRAWKGIVLILSSIVVTLVAWQNAGLSEFVVPGLALTSLSLTFLLSTKFRILESYFQGIENMYFYHKVMAVFSMILLLLHKIGLGQGGHGSEFAKTIGSAGLYLFLSIVFVAYFGNFLKYEIWRFIHRFVYLAYILGLVHTFMILGDRILGNTLLSLIVLGYAVIGVISGFYIIFLYSRMRFRRVGYVQKVTHLNHDTTEIEITMKRPYRYDYGQFTFLKIYQAGFESAAHPFSISGGHDRVIFLTVKASGDYTKSIYKQLKVGTKIALDRAYGRMLFDRDKKEQVWIAGGIGITPFISFIRENSILTKRVDFFYTFSNQDNLIYQDMLESYAKANPNFKLHLNNSSLQGRLDFSQSVFEGQPTIFMCGPTSMTSTYAKVFRQKDAKSRLVYEGFSFRDSWLSIFLLKTFDKVYSNLIK

SEQ ID NO: 273 - protein, 419 aa, Streptococcus agalactiae MRI Z1-215
MRAWKGIVLILSSIVVTLVAWQNAGLSEFVVPGLALTSLSLTFLLSTKFRILESYFQGIENMYFYHKVMAVFSMILLLLHKIGLGQGGHGSEFAKTIGSAGLYLFLSIVFVAYFGNFLKYEIWRFIHRFVYLAYILGLVHTFMILGDRILGNTLLSLIVLGYAVIGVISGFYIIFLYSRMRFRRVGYVQKVTHLNHDTTEIKIAMKRPYRYDYGQFTFLKIYQAGFESAAHPFSISGGHDRVIFLTVKASGDYTKSIYKQLKVGTKIALDRAYGHMLFDKDKKEQVWIAGGIGITPFISFIRENSILTKRVDFFYTFSNQDNLIYQDMLESYAKANPNFKLHLNNSSLKGRLDFSQSVFEGQPTIFMCGPTSMTSTYAKVFRQKDAKSRLVYEGFSFRDSWLSIFLLKTFDKVYSNLIK

SEQ ID NO: 274 - protein, 419 aa, Streptococcus agalactiae 515
MRAWKGIVLILSSIVVTLVAWQNAGLSEFVVPGLALTSLSLTFLLSTKFRILESYFQGIENMYFYHKVMAVFSMILLLLHKIGLGQGGHGSEFAKTIGSAGLYLFLSIVFVAYFGNFLKYEIWRFIHRFVYLVYILGLVHTFLILGDRILGNTLLSLIVLGYAVIGVISGFYIIFLYSRMRFRRVGYVQKVTHLNHDTTEIEIAMKRPYRYDYGQFTFLKIYQAGFESAAHPFSISGGHDRVIFLTVKASGDYTKSIYKQLKVGTKIALDRAYGHMLFDKDKKEQVWIAGGIGITPFISFIRENSILTKRVDFFYTFSNQDNLIYQDMLESYAKANPNFKLHLNNSSLQGRLDFSQSVFEGQPTIFMCGPTSMTSTYAKVFRQKDAKSRLVYEGFSFRDSWLSIFLLKTFDKVYSNLIK

SEQ ID NO: 275 - protein, 393 aa, Streptococcus agalactiae SA20-06
MRAWKGIVLILSSIVVTLVAWQNAGLSEFVVPGLALTSLSLTFLLSTKFRILESYFQGIENMYFYHKVMAVFSMILLLLHKIGLGQGGHGSEFAKTIGSAGLYLFLSIVFVAYFRNFLKYEIWRFIHRFVYLAYILGLVHTFMILGDRTLGNTLLSLIVLGYAVIGVISGFYIIFLYSRMRFRRVGYVQKVTHLNHDTTEIEIAMKRPYRYDYGQFTFLKIYQAGFESAAHPFSISGGHDRVIFLTVKASGDYTKSIYKQLKVGTKIALDRAYGHMLFDKDKKEQVWIAGGIGITPFISFIRENSILTKRVDFFYTFSNQDNLIYQDMLESYAKANPNFKLHLNNSSLQGRLDFSQSVFEGQPTIFMCGPTSMTSTYAKVFRQKDAKSRLVYE

SEQ ID NO: 276 - protein, 419 aa, Streptococcus agalactiae GB00300
MRAWKGIVLILSSIVVTLVAWQNAGLSEFVVPGLALTSLSLTFLLSTKFRILESYFQGIENMYFYHKVMAVFSMILLLLHKIGLGQGGHGSEFSKTIGSAGLYLFLSIVFVAYFGNFLKYEIWRFIHRFVYLAYILGLVHTFMILGDRILGNTLLSLIVLGYAVIGVISGFYIIFLYSRMRFRRVGYVQKVTHLNHDTTEIEIAMKRPYRYDYGQFTFLKIYQAGFESAAHPFSISGGHDRVIFLTVKASGDYTKSIYKQLKVGTKIALDRAYGHMLFDKDKKEQVWIAGGIGITPFISFIRENSILTKRVDFFYTFSNQDNLIYQDMLESYAKANPNFKLHLNNSSLKGRLDFSQSIFEGQPTIFMCGPTSMTSTYAKVFRQKDAKSRLVYEGFSFRDSWLSIFLLKTFDKVYSNLIK

SEQ ID NO: 277 - protein, 419 aa, Streptococcus agalactiae CCUG 25532
MRAWKGIVLILSSIVVTLVAWQNAGLSEFVVPGLALTSLSLTFLLSTKFRILESYFQGIENMYFYHKVMAVFSMILLLLHKIGLGQGRHGSEFAKTIGSAGLYLFLSIVFVAYFGNFLKYEIWRFIHRFVYLAYILGLVHTFMILGDRILGNTLLSLIVLGYAVIGVISGFYIIFLYSRMRFRRVGYVQKVTHLNHDTTEIEIAMKRPYRYDYGQFTFLKIYQAGFESAAHPFSISGGHDRVIFLTVKASGDYTKSIYKQLKVGTKIALDRAYGHMLFDKDKKEQVWIAGGIGITPFISFIRENSILTKRVDFFYTFSNQDNLIYQDMLESYAKANPNFKLHLNNSSLQGRLDFSQSVFEGQPTIFMCGPTSMTSTYAKVFRQKDAKSRLVYEGFSFRDSWLSIFLLKTFDKVYSNLIK

SEQ ID NO: 278 - protein, 419 aa, Streptococcus agalactiae GB00112
MRAWKGIVLILSSIVVTLVAWQNAGLSEFVVPGLALTSLSLTFLLSTKFRILESYFQGIENMYFYHKVMAVFSMILLLLHKIGLVQGGHGSEFAKTIGSAGLYLFLSIVFVAYFGNFLKYEIWRFIHRFVYLVYILGLVHTFLILGDRILGNTLLSLIVLGYAVIGVISGFYIIFLYSRMRFRRVGYVQKVTHLNHDTTEIEIAMKRPYRYDYGQFTFLKIYQAGFESAAHPFSISGGHDRVIFLTVKASGDYTKSIYKQLKVGTKIALDRAYGHMLFDKDKKEQVWIAGGIGITPFISFIRENSILTKRVDFFYTFSNQDNLIYQDMLESYAKANPNFKLHLNNSSLQGRLDFSQSVFEGQPTIFMCGPTSMTSTYAKVFRQKDAKSRLVYEGFSFRDSWLSIFLLKTFDKVYSNLIK

SEQ ID NO: 279 - protein, 419 aa, Streptococcus agalactiae CCUG 44074
MRAWKGIVLILSSIVVTLVAWQNAGLSEFVVPGLALTSLSLTFLLSTQFRILESYFQGIENMYFYHKVMAVFSMILLLLHKIGLGQGGHGSEFAKTIGSAGLYLFLSIVFVAYFGNFLKYEIWRFIHRFVYLVYILGLVHTFLILGDRILGNTLLSLIVLGYAVIGVISGFYIIFLYSRMRFRRVGYVQKVTHLNHDTTEIEIAMKRPYRYDYGQFTFLKIYQAGFESAAHPFSISGGHDRVIFLTVKASGDYTKSIYKQLKVGTKIALDRAYGHMLFDKDKKEQVWIAGGIGITPFISFIRENSILTKRVDFFYTFSNQDNLIYQDMLESYAKANPNFKLHLNNSSLQGRLDFSQSVFEGQPTIFMCGPTSMTSTYAKVFRQKDAKSRLVYEGFSFRDSWLSIFLLKTFDKVYSNLIK

SEQ ID NO: 280 - protein, 467 aa, Desulfovibrio gigas DSM 1382
MREFTLRQRMLPAFERGALLGLFWLATAGLAGMAAARPFWIRWEALNAYGEALDWTTAIGKGCGGAALVLLLVQALLGARSRWMDALFGLDLVYRVHRLLAVGILVLITLHPMFLHFYRPFAQELAWSAWPLVLGSLVLAGLWISAVLARFRRFVELPYHWWQLGHRLAAWPLLFGAFVHVLSVSEDYRRFPGIVMALLGLAFLVVLALRTRLLKRFGFARTPHVVQAVRPPSPEFPDAVELILAPQPGARGLQFTPGQFVFLLPESKAVPAEEHPFTIASAPDSLPRLSFTIRCCGDFTSRLGQLAPGDTVLVDGPYGRFSYAGLAPMNSPLLLVAGGVGITPMLSMLRTLAHEQDPRALCLVWSTRTREDVLHAQELRELEVALENLRVIHVFSRQRMSANLAERSGRLRPSILKDALAILPHTPQDPPPHAFICGPASMMLVARQSLLGLGMPARRIHVERFSL

SEQ ID NO: 281 - protein, 439 aa, Dehalobacter sp. DCA
MRERQGPLFILLTLILTFIFWSVSEPLKDVAPVRQYSEMAASLMLVCFAWVNFISTRHPLLDSLFHGLDKSYLYHKALSIISVLLIFVHRFTLDAGKGNHYGENRANLGPGPNGLNGPPPGAENGAEFFSGIANLSMLLFIVLILLALFVWKTNYEKWKNIHKLFFIPYMIGIIHYYGSSDYAVTGLSALGLWLNLVNLVGLTSAIYSIGFYERTAFQPRYVVTNIRTVAKDTLEITGKALKKGIRYKEGQFTFIKFTEEGKKFPSHPFTISQSFRKNEIQFAIKALGDHTSALLENVQEGDTFAVTSSHGRFDYKAGSNRQVWLAGGIGITPFRSFYQSAIPPQYSIDLFYCYNNEAEGPYLDEIKTLAAGSGIRVHLHDLQTKGFLDAEDICEAVPKTETVDVYFCGPEPMRIKLERELKTCGLRIGHFHYESFQFK

SEQ ID NO: 282 - protein, 460 aa, Acidovorax ebreus TPSY
MRIKIAVGACLLAITLAWQAALPPELGIFPLVDAQGAATGWWQLRQQALYLSGLWSIGLMALAMVLALRLPWLERPLGGMDQVYRLHKWAGISAALTAILHWGADESSDWIKGLWGRAGRPARDAVLPWLTDARGLAKDLGEMAFYLLLAMVAITLLTRLLAYKPWRFLHRAMPLVFLALTLHTVALMPLTFWTLPLGLLMGTLLALGSLAAVWSLAGWIGRARSHTGRIHAVQVLGDGGAAAPIEVICALPASWPSHRAGQFAFVRFDAWEGAHPFTIASAPGSLGTNAQGEQLLRLVIKPLGDYTRTLGRRLQAGQRVDIEGPYGRFDGRGRRRRQQVWVAGGVGITPFLALLEARQPGATPAPSKLQPVQMHYCTRDAATDPLLPRLRTLCAQAQPPVTLTVHGDAQGQRLRPQDLEATPGPLDIWFCGPQGLGDALHAHASGTRPWRLHRESFAMR

SEQ ID NO: 283 - protein, 489 aa, Acidovorax sp. JS42
MRIKIVLGGWLLAITLAWLAVLPPELGVSPLVDAQGAATGWWQLRQQALYLSGLWSIGLMALAMVLALRLPWLERPLGGMDQVYRLHKWAGIGAALTAILHWGADASSDWIKGLWGRAGRPARDAVLPWLTDARGFAKDLGEMAFYLLLAMVAITLLTRLLAYKPWRFLHRAMPLVFLALTLHTVALMPLTFWTLPLGLLMGTSLALGSLAAVWSLAGWIGRARSHAGHIHAVRTLGDGGAAAPVEVICALPASWPGHRAGQFAFVRFDASEGAHPFTIASAPGSLGTSAQGEPLLRLVIKPLGDYTRTLGRRLQAGQRVDIEGPYGRFDGRGRHRRQQVWVAGGVGITPFLALLEARQPGATPAPSKLQPVQMHYCTRDAATDPLLPRLRTLCAQAQPPVTLTVHGDAQGQRLRPQDLEATPGWTSGSAVRRVWAMRCTRTPAAPARGACTASPLPCVDPPKGAFHETPDPVAGPVPGPGSSPCAGGR

SEQ ID NO: 284 - protein, 425 aa, Spirochaeta africana ATCC 700263
MRKLTIYTAIAAMLLLPAGVVLYEAGWYFMPTVQGTQLLGLWALVLLLFQFILTARVRLLDRWIGLDQLIHLHRLIGMGVLVTAVLHGALYSIPAAFEGRLTPDMPGDWPIALGSTALLLLLAIGITAMLYRKLGWRYETWKRIHQGAYLLLPLVLLHGFVFGSHLSWHPVLQLQILAGTAVVVWLLLTRGIRFIRRTPMTLRRAEQVTHDTTRLVFDRPQGFRFVPGQFVFLRIRGRTLSEPPHPFTLSGNADADHLEITAKAIGDFTARLPGLQPGDQVSIDGPFGVFHPLPQQDKVLWIAGGIGITPFLAALRSLETRDHPEIVLIWGNKTPADIPYQQELRTLLETDPGIRLMHVFSENSEPEPDFGEVYHGFVTAALLKDAADEDLPRTSICGPPAMRRAVLPLLRDIGIRSIAYERFDL

SEQ ID NO: 285 - protein, 439 aa, Vibrio proteolyticus NBRC 13287
MRKLYGLAAAVLLMVTAFWWSADSAVLISGSFFQVRAALIQLSGILSVTLMVMVMLLALRLPWVEKLTHGLDKSYRWHKWLGIGAVTTAIVHWLIIKVPKYLVSWGLLSKPVKNHIPPDPDSWFALVAPWHSEAKSVGELAFYLLLVLALISLSKIVKYKGFKWSHKLMAVCFLAIGFHSVVLIKRNYWQEPVALLVIGMCLVGVLAALWSLSNRIGRARRYPGIVREVTYHECNKVTHLVIDVPEWKGHQSGQFAYLRCQGHEAHPFTIASYDDGSHQLQFMIKALGDFTCGLNGRLSAGDEVTVEGPYGEFAFTDEGPALWIAGGVGIAAFKSILEERVNHPSSYPTIMYYCTACPDPSLIEELHHSARLANVTLRVLDSRSDARLTAERLQREVSGLLKRNVWFCGPAMFADSLRRGLQEQGFDARRFHHELFEMR

SEQ ID NO: 286 - protein, 439 aa, Agarivorans albus MKT 106
MRKTTATIMLLLAAITGLWLQAEPNLFSSDNFFQWRSALIQYSGMLAVGLMSIAMLLALRLPFIEWLTKGLDKSYRLHKHLGIASVLVAAVHWLLAIIPKQLVRAGILDKPVRGTGPNNSDSLYALVRPLRGLAEQVGEVAFYSFVVLAIVALVGVIRYKGFRYSHKLMSLAFLAIAFHSVILIKHSYWPYPITYACLALIWVGSVAAVYSLFGRIGKTKQHTATVANFRFLPQDKVVDLRLSVPNWHGHNSGQFAFIGFPGEEPHPFTIASTNTGTGHVRFLIKELGDFTANLKSRLNIGQELKVEGPYGNFDFNDSAPQLWIAGGIGIAAFTAILQQRQTMNNPPKATLYYCSETLEPKLIEELQQLSSSSQVELRIIDNSRQALLSAEQLVNEVEDLMQRKIWFCGPVAFSSNLQQQLAHFGYPLKHFHSELFELR

SEQ ID NO: 287 - protein, 443 aa, Sphingomonas sp. MM-1
MRLTRLKLVPVALTLVLVAAWLLSLRTGALTGGFWALRHELIYLTGILAIGFMAAGVVLAARPVQIEGALGGLDKFYRLHKWFGVGGLLLALAHWLLEIIPRWMVGQGWLVRPSRLRASGPAADANLLDSLRGVATELGEIALYILIVLVLLALWKKFPYRWFFKAHRLMAPIFLVLVFHAVVLMDRSYWTAPLGPLMIVLLAAGTVAATTALFRRIGYSRRAAGVITRLVTYPGNAVLDVAVDVGTAWPGHQAGQFVFLKTDDREGAHPFTISSAWHNDGHLLFNIKGLGDYTRKLPDLLRVGQPVTIEGPYGRFDFGGECARQVWIAGGVGITPFIARLQALAQARQERDIDLFYSTGAPDEDFVGQVRDLTEKAGIRFNLLVTPRDGFLTLDRLADLVPDWIEADIWFCGPAAFGRSLYVAMTSRGLPGSQFHQELFEMR

SEQ ID NO: 288 - protein, 447 aa, Labrenzia alexandrii DFL-11
MRPLGLALIALAVLIPVYWFAPIASERDPVALFSQYLGAAALILMGINQFVATRAPGLEIVFGPLDRIYVLHKWLGVIALIAMGLHDIIDADMNGLRGGVLSGIAEDIGEISLYGLMILILASVITFIPYHLWKWSHRIIGVFFFLGAFHFFFIAKPFSNFDPLGLYVSAFCILGIVSYIWMSVVRPMAPRGHRYEVDLVRRVGGLTELVLLPKGGGMRHKPGQFAFLSIDGGGLGEEHPFTLSGAPTDDRVLRFSIKDLGDYTDRLQRTVQPGMDAIVSGPFGHFSMPRGRDPQVWIGAGVGITPFLAFAESLKGRETGPIKLYYCVRERDDIPYAVELERLAEEVDTLELIIVNSSEGIRLTSDRIVSDLGGDVANAHVFFCGPVPMRKALKSGLLLKGLKASRFHFEEFEMRTGIGLQSLAVWLWDRGKYEVVKRVSRQTEPAE

SEQ ID NO: 289 - protein, 447 aa, Labrenzia sp. C1B10
MRPVGLALIALAALIPLFWFAPLAASRDPVALFSQYLGTAALIVMGINQFLATRVPGLELVFGPLDRIYVLHKWLCIIAMVGLGLHDIIDADMDGLRGGPLADAAEDIGEVSLYGLLILVLASVITFIPYHLWKWSHRLIGVFFFMGAFHYFFIEKPFANADPLGLYVSAFCVLGLVSYVWMSVLRPLAPRGHAYKVASVRHINGLTEVLLEPRGRGLKHVAGQFAFLSVKGGGLTEEHPFTLSAAPRDDRSLRFTIKDLGDYTSRLYRELKVGMEATVSGPYGNFSMPSGRDPQVWIAAGVGITPFLAFAQTLKHRESGPIKLYYCVRERGDIPYVADLQHLAEETGKLELMIVNSLEGVRLTPERIVEDLKGDLRNAHVFFCGPASLRKTLKSSLVLKGLRASRFHFEEFQMRTGIGLGRLTVWLWDRGIYAIEKRRAEKTQPAE

SEQ ID NO: 290 - protein, 479 aa, Bordetella parapertussis ATCC BAA-587
MRQIKAGGERPMHNGPGATGIFRKRYRARSGDAMRRLRTIFIPLVAALSVLWLSQNPPGAWGEGFWVMRKPLIYYTGILALGMMSLGVILAARPARFEGALGGLDKFYRLHKWLGLGGVALALTHWLLKIVPPWMAGQGWTVRPPRVPAPAGQAALYDPFQAWHGVAKSLGEWGLYALLLLAALALYKRFPYRHFFRTHRLMPALYLVFVFHAVVLMAPAYWRGPIGPVMAVVMAAGGAGALLSLLGLIGRPRQAAGRIARLERFADNAVMQVDVQLETRWPGHRAGQFAFVTFDRAEGAHPFTISSAWRDDGLLRFSIKGLGDYTRSLPARLRVGDGVTVEGPYGRFDFCANGRPQILVAGGIGITPFLARLQDMAAARSDGAPAHEVDLVYSTNAPDPDFIGELRALAERARVGLHVLVTQRDGKLSAERLVDMLPRAVQSEVWFCGPAGFGQALREGLAARGMPPACFHQELFEMR

SEQ ID NO: 291 - protein, 443 aa, Pseudomonas stutzeri NF13
MRQIKLTYFALFVGLTLLWLLVDDFIMARYQFWPLRKVMVHFSGVFGIVAMSVAMVLAVRPRRFERLFDGLDKTYRLHKWLGISALVIAIFHWGWGQIPKWLVGFGWLAKPARRAGEGQLHEGIFALLQRFRGLAETIGEWAFYAAAILVVLALVKRFPYRWFFKTHRWLALVYLALVAHSVVLTPPDYWASPLGLVLAVLMVSGSIAACISLLRRIGRKHQVVGRIESLTYHRDNRVLRVDIKLDGPWPGHKAGQFAFVTFDDREGPHPFSLSSAWCNDGKLAFSIKGLGDYTRTLPDTLKVGDAVKVEGPYGCFDFHSRKPRQIWIAGGIGIAPFIGRLQALAASGRGDNVDLFYCTSAPDQRFLERIRELAERARVRLHVLVASEGGRLTPERLRQLAPQWHDSDVWFCGPAGFGQDLRKDLQRHGLPPRDFHQELFNMR

SEQ ID NO: 292 - protein, 443 aa, Pseudomonas stutzeri CCUG 29243
MRQIKLTYVALFVGLTLLWLLVDDFIMARYQFWPLRKVLVHYSGVLGIVAMSVAMVLAARPRRFERFFDGLDKTYRLHKWLGISALVIAIFHWGWGQIPKWLVGFGWLEKPARRAGEGQMHEGIFALLQRFRGLAETIGEWAFYAAAILIVLALVKSFPYRWFFKTHRWLALVYLALVVHSVVLTPPDYWTSPLGLVLAVMMASGSVAACISLLRRIGRKHQVVGRIDGLTHHRDNRVLRVDIKLDGPWPGHKAGQFAFVTFDDKEGPHPFSLSSAWCNDGRLAFSIKGLGDYTRTLPDTLKVGDAVKVEGPYGCFDFHSRKPRQIWVAGGIGIAPFIGRLQALAASGKGDNVDLFYCTSAPDQSFIERIRELAARARVRLHVLVASEGGRLTPERLRQLAPQWQDSDVWFCGPAGFGQDLSRDLQRHGLPPRDFHQELFNMR

SEQ ID NO: 293 - protein, 443 aa, Pseudomonas chloritidismutans AW-1
MRQIKLTYVALFVGLTLLWLLVDDFIMARYQFWPLRKVLVHYSGVLGIVAMSVAMVLAVRPRRFERFFDGLDKTYRLHKWLGISALVIAIFHWGWGQIPKWLVGFGWLEKPARRGGDGQLHEGIFALLQRFRGLAETIGEWAFYAAAILIVLALVKRFPYRWFFKTHRWLALVYLALVAHSVVLTPPDYWTSPLGLVLAVMMASGSVAACISLLRRIGRKHQVVGRIDGLTHHRDNRVLRVDIKLDGPWPGHKAGQFAFVTFDDKEGPHPFSLSSAWCNDGRLAFSIKGLGDYTRTLPDTLKVGDAVKVEGPYGCFDFHSRKPRHIWVAGGIGIAPFIGRLQALAASGKGDNVDLFYCTSAPDQSFIERIRELAARARVRLHVLVASEGGRLTPERLRQLAPQWQDSDVWFCGPAGFGQDLSRDLQRHGLPPRDFHQELFNMR

SEQ ID NO: 294 - protein, 443 aa, Pseudomonas stutzeri DSM 4166
MRQIKLTYVALFVGLTLLWLLVDSFVMAHYQIWPLRKVMVHYSGVLGIAAMSVAVILAARPRRFERFFDGLDKTYRLHKWLGISALVIAIFHWGWGQIPKWLVGFGWLERPARRAGEGQVHEGIFALLQRFRGIAETIGEWAFYAAVILIVLALVKRFPYRWFFRTHRWLALVYLALVVHAVVLTPPDYWTSPLGLVLAVLMAAGSLAACISLLRRIGRKHQVVGRIESLTHHRDNRVLRVDIKLDGAWPGHKAGQFAFVTFDDKEGPHPFSLSSAWCNDGRLAFSIKGLGDYTRTLPQTLKVGDPVKVEGPYGCFDFHSRKPRQIWVAGGIGIAPFIGRLQALADSGNGDNVDFFYCTSAPDQGFIERIRELAERARVRLHVLVASEGGRLTPERLRQLAPQWQDSDVWFCGPAGFGLDLSRDLQRRGLPARDFHQELFNMR

SEQ ID NO: 295 - protein, 443 aa, Pseudomonas stutzeri B1SMN1
MRQIKLTYVALFVGLTLLWLLVDSFVMAHYQIWPLRKVMVHYSGVLGIAAMSVAVILAARPRRFERFFDGLDKTYRLHKWLGISALVIAIFHWGWGQIPKWLVGFGWLERPARRAGEGQVHEGIFALLQRFRGIAETIGEWAFYAAVILIVLALVKRFPYRWFFRTHRWLALVYLALVVHAVVLTPPDYWTSPLGLVLAVLMAAGSLAACISLLRRIGRKHQVVGRIESLTHHRDNRVLRVDIKLDGAWPGHKAGQFAFVTFDDKEGPHPFSLSSAWCNDGRLAFSIKGLGDYTRTLPQTLKVGDPVKVEGPYGCFDFHSRKPRQIWVAGGIGIAPFIGRLQALADSGNGDNVDFFYCTSAPDQGFIERIRELAERARVRLHVLVASEGGRLTPERLRQLAPQWQDSDVWFCGPAGFGQDLSRDLQRRGLPAWDFHQELFNMR

SEQ ID NO: 296 - protein, 443 aa, Pseudomonas stutzeri RCH2
MRQIKLTYVALFVGLTLLWLLVDSFVMARYQIWPLRKVMVHYSGVLGIAAMSVAVILAARPRRFERFFDGLDKTYRLHKWLGISALVIAIFHWGWGQIPKWLVGFGWLEKPARRAGEGQMHEGIFALLQRFRGLAETIGEWAFYAAVILIVLALVKRFPYRWFFKTHRWLALVYLALVAHAVVLTPPDYWTSPLGLALAVLLVSGSVAACISLLRRIGRKHQVVGRIESLTHHRDNRVLRVDIKLDGPWPGHKAGQFAFVTFDDKEGPHPFSLSSAWCNDGKLAFSIKGLGDYTRTLPDTLKVGDAVKVEGPYGCFDFHSRKPRQIWVAGGIGIAPFIGRLQALAESGKGNNVDLFYCTSAPDQGFIERIRQLAERARVRLHVLVASEGGRLTPERLRQLAPQWQDSDVWFCGPAGFGQDLSKDLQRHGLPPRDFHQELFNMR

SEQ ID NO: 297 - protein, 443 aa, Pseudomonas stutzeri ATCC 14405
MRQIKVTYVALFVGLTLLWLLVDSFIMARYQFWPLRKTLVHYSGVLGIVAMSVAMVLAVRPRRFERFFDGLDKTYRLHKWLGISALVIAIFHWGWGQIPKWLVGFGWLEKPARRAGEGQMHEGIFALLQRFRGLAETIGEWAFYAAVILIVLALVKRFPYRWFFKTHRWLALVYLALVAHAVVLTPPDYWTSPLGVVLAVMMASGSVAACISLLRRIGRKHQVVGRIDGLTHHRDNRVLRVDIKLDGPWPGHKAGQFAFVTFDDKEGPHPFSLSSAWCNDGKLTFSIKGLGDYTRTLPDTLKVGDAVKVEGPYGCFDFHSRKPRQIWVAGGIGIAPFIGRLQALAESGKGDNVDLFYCTSAPDQGFIERIRELAASARVRLHVLIASEGGRLTPERLRELAPRWHDSDVWFCGPAGFGQDLSKDLQRHGLPSRDFHQELFNMR

SEQ ID NO: 298 - protein, 436 aa, Achromobacter piechaudii HLE
MRRILAAVLLLSLLAWTGTVWTNPLAEFNIWTLRDQLILLTGLGAYALMALIMLLAVRPQWIESRLGGLDKMYRLHKWSGILATALAAAHYLVKMGKPLLLALFDPVPKTPRATAWLDMFRGSAKDIGEWAVWILVALVVLTLWRRFPYHLWRQVHRIAAVVFLVVAFHGVVLTPAAWWWQPAGWLVAAATAVGSVCAVMALTGLIGRARRHKGLVLSVDPLSDDILSLTCRVEGDWHHRAGQFAFLTADRREGAHPFTVSGADDGTGRVQFSIKALGDYTRRLQTSLKPGQAVMVEGPYGCFDLQQDDGRPQIWVAAGIGVTPFISWLESLQAEPERAPQAALYYCARNEADAPFARKLETLCAQVPRVALRVWYSEGQRPLTAADLLKGHIAGAPWPSVWFCGPNGFADALKDGLHRRGMPVRRLFHQEAFQMR

SEQ ID NO: 299 - protein, 437 aa, Alcaligenes faecalis subsp. faecalis NCIB 8687
MRRPLFLLLSTFFLIWAVQALWLSPSPPGDTLWVIRQEGMLLTGILALGTMTAIMVLALRPRRLEPWLGGMDKAYKLHKYLGILAILLSLAHWLSKQSKDLIAAAIGTSGKLAKVPVPEWVSLFKPYAKTLGEWTFYALIVMLIITLAHRTISYKKWYSLHRLMPVAYLILVFHGVVLTPPAYWSGIGGWLLAVSLVIGTVAASIQLLRNLSSAYPHTGTVISCTPQGDVLEVQCRMDQSWPGHQAGQFAFLRLKGETESHPFTLSDADQDDQIVRFHIKQLGDWTRRLPERLHIGQNIELDGPYGRFTQPGRDDKGVYIWVGAGVGATPFLSWLSQEHEEGHAPYAYLQYACQHSSDPLAQALSNAAKEHPDVKLDIYADGRRWTPQEVVQHYQAGRPLHIWFCGPAGMGKQLQRELKRALPAKSWTLHKEHFQFR

SEQ ID NO: 300 - protein, 437 aa, Alcaligenes sp. HPC1271
MRRPLLLLLSTFFLIWAVEALWLAPSPPGDMLWVVRQEGMLLTGILALGTMTAIMILALRPRRLEPWLGGMDKAYRLHKWLGIIAILLSLAHWLSKESKGLISAAIGTGGRLAKTPVPEWVSLFKPYAKSLGEWTFYALILMLIITLAHRTISYKKWYSLHRLMPVAYLILIFHGVVLTPPAYWSGIGGWALAITMMIGTAAAGIQLLRNLSSAYPHTGTVISCTSQGDVLEVQCRMDQSWPGHQAGQFAFLRLKGESESHPFTLSDADQDNQIVRFHIKQLGDWTRSLPERLHVGQNIELDGPYGRFTQPDRDDKGIYIWVGAGVGATPFLSWLSQEHQDGHAPYAYLQYACQHSTDPLAQALSKAAKEHPDVNLEIYADGRRWTPKEVLQHYQADKPLHIWFCGPAAMGRQLRRELKQTLPAKSWTLHKEHFQFR

SEQ ID NO: 301 - protein, 436 aa, Achromobacter arsenitoxydans SY8
MRRVLPAVLLISLLAWAGACWLHPPAQINVWTARDQLILLTGLSAYMLMALIMLLAVRPMWLERRLGGLDKLYRLHKWSGIAATALVAAHYLIKLAKPLLLAVFDPVAKTPREAAWLDVFRGSAKDIGEWALWILLAMVALTLWRRFPYHVWRQVHRIAAVIFLVAAFHGVVLTPAAWWWLPAGWLVGAATAVGTVCAVLALTGNIGRARRYKGKVLDVQHLSDDILTVTCKVEGDWHHRAGQFAFLTADRREGAHPFTVSGADDGTGRVQFSIKALGDYTRRLQGSLVVGQAVTVEGPYGCFDFQRDDGRAQIWVGAGIGVTPFISWLESLQARPADAPKAELYYCARNAADAPFAQRLRELCERIPNVTLHVRYSDRERPLTAAELAQDRPAGAPWPSVWFCGPTGFADALKDGLHRRGMPVRQLFHQEAFQMR

SEQ ID NO: 302 - protein, 421 aa, Clostridium beijerinckii ATCC 51743
MRSISGKLVILMSMIITWVLWLFVEPIREISTMSGYSQLIAAFALVAFAFINFISTRHKILDGLFGGLDKSYIYHKYLSICALALAVIHNITISMGKKIERANGIKIPKDPYAMYGTFSMYIFIVLILIALVAKKLNYEKWKTIHKFMIIPYAFGIYHYYGSATYAVFSLEPFCIWLNLINIIGITSAIYSVFLYEKISFKYKYKVKKLDIVANGTFEITGDSIGKEIKFKPGQFAFLKILDNENGFVSHPFTISEAPKNGELQFTIKALGDHTKELLNTLKVGDEFVVSGPHGKFNYKTGVKNQIWIAGGIGITPFRSFAQSGVGEEFSVDLFYAYNNEAEGAYKEELQLLNSNNLRVHLFNSKEKGFLSVNEISKVVNTKDSVDVYFCGPAPMRENLKKQFKDSNFNIINFNYEHFQFK

SEQ ID NO: 303 - protein, 443 aa, Pleurocapsa sp. PCC 7327
MRSLLMKNPLIIGLSWIGLYLAIILFPLLILLFYPPTPSEERSFWLEFSVALGFIGLAMMAMQFALTARINRIEASYGIDLILQFHRYTSIVAFLFIFVHPIVLFIDNPETLQLLNFLEAPWRARLAAIATLALIAIIVTSIWRKQLNIPYEPWRIAHGILAIVAVGFGLGHALGVSYYLSLFWKGVIWTGIALAALWLLIYVRLVKPWLMVKKPYLVEAILPQRGNVWNLVLRPRGHQGMHFQPGQFAWLTLEISPWRMREHPFSMASSAEHPEYIEFGIKAVGDFTNTIKDVKPGTKAYLDGPYGVFTTDRYENTAGFVFIAGGIGITPIMSMLVTLAEREDERPLLLIYASKTWEDVTYREEIEELKEKLDLTIAHVLREPPSDWSGETGYVDKELLQRYIPKRPATRNYFICATPKMMDVVESALHELGVPVTNVHMEH

SEQ ID NO: 304 - protein, 447 aa, Nostoc sp. PCC 7120
MRSLLMKNPVVIGASWIAAYIVIILFPLFILLLYPPTPSNERSFLLEFSAALGFIGLAMMAMQFALTARINRIEASYGVDLILQFHRYTSIVAFLFLLAHPIILFINNPETLQLLNFFQAPWRARAAVIATLALIAIIVTSIWRKQLNIGYENWRIAHGILAVIIVSFGLGHVLGVLNYLSLFWKAVIWTGIAIAALWLLIYIRLVKPYFMLKKPYLVEAVIPQRGNVWNLVLRPRGHQGIYFQPGQFAWLTLEISPFRMREHPFSIACSAEHSDRLEFGIKALGDFTKTIKDVKPGTKAFLDGPYGVFTTDRYENTAGFVFIAGGIGITPIISMLFTLAERKDERPLLLIYASKNWEDITYREEIEALTDKLDLTVIHVLKEPPEDWSGESGYVDQQLLERYIPKRPATRNYFICAAPKMMDQVEIYLHNLEVPITNIHMEHYNLV

SEQ ID NO: 305 - protein, 417 aa, Pseudomonas sp. CMAA1215
MRTWHTIVGVLLITTFTLLMEIPSQTWLTSATLSLVLGSAALAYMALSCLLSSRWRWTERLFGGLDRVYETHKWLGIWALAFASYHLVFKANLDEWNSVPILELSKYWTRMVRQLSYVALGLIVLLALNRNIPYSQWRWWHKLSGPLFLVVILHWLSFKSPIALDNPSGIWLGLLCVLAVLGALYKLLLYPFLAKAGEYQVTAVRIERNSLHLELIPQGRGFPFKAGQFAFLAMQEKGLREPHPFTIASAQAHDGRIEFVIRALGDYTQRLHKQVKVGMLADIYAPYGRFKRPLLAAREIWIGGGVGISPFIAWLQDQAAGKLDRATLVYCYNPSRAFPSVDALQGMAQARGVGFVANSGGVEPLAQTLKRAAAETDPGQIQVSFCGPKGLLGRVRELMHECRIPEANLHYEFFEFR

SEQ ID NO: 306 - protein, 417 aa, Pseudomonas chlororaphis subsp. aureofaciens 30-84
MRTWYSVVGVLLITTLTVLLEIPSDTWLTSATLSLVLGATALAYMALSCLLASRWRWVERLFGGLDRVYESHKWLGIWALVFASYHLVFKANLDLWQSVPIIELSKYWTRMVRQLSYVALGLIVLLALNRNIPYGQWRWWHKLSGPLFAIVILHWLSFKSPIALDNPSGIWLIALCGLGLLGALYKLLLYPLLAKAGEYRVSAVTLEKNSLHLELTPLHRSFAFKAGQFAFLAMREKGLREPHPFTIASARASDGRIEFVIRALGDYTQKLRQQVKVGMLADLYAPYGRFKRRLDAGREIWIGGGVGISPFISWLQDAAAGRFDQATLVYCCNPSRAFPSLETLQGLAEQRGVAFIGHTDGADRLGETLQRLVSETDPQQIQISFCGPKGLLARVKALMREYAIPERNLHYEFFEFR

SEQ ID NO: 307 - protein, 424 aa, Tolumonas auensis DSM 9187
MRYLFLLLLISLSCWGLTLPLDAMQQGFLFWRNQGVQLTGILALALMGALMLMATRPAWLEQRLGGLDHLYQLHKWSGITAGSMVLLHWLLTKSPRWLVDWGLLELGPRPAGAHVPDVWRGIAKEVGEYCFYAMILFMIVSLVKVLPYGRFRQIHKVGAVLFLLAAFHSIYLLPDATRWTPFGLLTLIAGVLGSLAALWSLFGLIGRPRRYPGQIIEIREHDGNVLELEVVLPTDFQDEYLPGQFALLTLHKEEGSHPFTIVREDVQNGSIIFAIKALGDYTRQLIGQVQEGDEVTVEGPYGRFVLPESGGQEYWIAGGIGITPFLAWLEGLVAEGYHRPGAHLYYCVNNRQEILFAERLQQLSKQTGVKVTIVDRETDGFLDPSRLDIDEDTRLWFCGPKGMRDMLLKHVPASQLHYEQFDFR

SEQ ID NO: 308 - protein, 440 aa, Desulfovibrio alkalitolerans DSM 16529
MSAKPVTLAAASGLGARLLLLAAVLTVIGAPLIVLAGEQAPPYSPEWWRAAGRSVGMAAALCLAVQFAIASRCRLLDRFAGLDRLFLGHRAFGIAAALLALSHPFIIFYPEEVGLGAPAISQWPLVAGATALTMLWGLAAVARWRAWLELPFHLWLPAHRLAALGLALVVGLHASFVGGPFKAADLALPLIAAVYLLLRFAPRPLHCRVKSVTPLGGEAHEIVLAPESGPVFDHAPGQFAFLTLQSPALPREEHPFTIASAPGEDALRFTIRCSGDYTARLGALSPGDTTFVRGPYGRFSHLVRGAPPADELLFLAGGVGITPMLSMLRHMAASAHAGPEAAKRHVTLIWCNRTPEDVVHAEEIGTLAATLPGFRLHHVFTRGPSTARLDGPGLASLITEVPRQARCFVCGPPPFMAFCRDALLREGFAPSRIHLEEFAL

SEQ ID NO: 309 - protein, 442 aa, Tistrella mobilis KA081020-065
MSAPKRLLIAFLVVLPGLWLATGQIFQAPAEIFAIRPAMMQGTGILAIGAMSLALVLAMRPVRLEGLLGGLDKGYRLHKWLGITALVAAVIHWLWAQAPKWAVGWGLLDRPARNRVPVEPGTLEATLRSWRGFAESVGEWAFYAAAALILLALIRRFPYRRVFQVHRLLALAYLVLVFHAAVLFTFDQWVQPVGIVVALLLAAGTVSALLALFGRIGIRRRVAGRVSRLAHDPATHVLEVDLALSGSWPGHRAGQFAFVTFDAAEGPHPFTISSAWQGDGRLRFHVKALGDHTRALPARVKQGDPVTVEGPYGRFDFIDHQPAQLWVAGGIGITPFLARLEALAAAPERRPVDLVYCAAAPAPDVVARLQALATAAGVRLHILASGRDGRLDAGRLAGLVPGWREASIWFCGPAGFGRSLRRGLERLGLARGRFHQEAFEMR

SEQ ID NO: 310 - protein, 441 aa, Nocardioides sp. CF8
MSERGLLTVVLAGTAAVLGLWWHDTTILAGLGEWLTSAGRLTGLLGGYAVAVILLLMSRAPWIEHGLGSDRLARWHAMGGRYLLSLLIAHAVLITWGYAITAQTGFLAEASTLLVAVPNVLIATIGLGLLVVVGAISARTVRRRVSYETWYLIHLLTYIAVALSFLHVLSAGADFQTGWAKAAWIALYAAVGAALLWYRWLVPVRDALRHRLRVASVTTEAPGVVSITVAGEGLDRLGAQPGQFFRWRFLTPSGWWQSHPFSLSATPTDTELRITVKDLGDHSRDLQRLRPGTKVIAEGPYGAFTPARRRGHGVLLLAGGIGITPLRTMLEHHAHDTGADTELDAGPVTLLYRANHAEEIILAHELNTLARAEHIEVHYVLGAPGSDTDVLVDHRLRHLIPDLEDRDAFVCGPPRFMDAARDSLLRCGVPARHIHTEQFTF

SEQ ID NO: 311 - protein, 450 aa, uncultured bacterium
MSETKIIPVKSYTAQKIAMWLLVLALLLILTRIGARHYFRDEAVKAGTFPVTVARICALWAIALILLQPVLAIRNRFLDRVFGLDRLLKFHRLSGIACLILASFHPMLMYVSGLKKLGPLASSQWPEAIGGICIAGLWLMVVSSVWRKFLALSYEEWLKLHKFTAPVAFVALAHMFIIESAMRNGWLLAFWVIFLALWAGFLLAEKFVLRAQRAAGESFVVSSVAAVADGIWQIGLKPASDAARFNFLPGQFAFISFDNPEIRHEEHPFTIASAPSDGNALQFMIKASGDWTKKLAAVKEGNPARVSGPFGVFSAYRHEISSLVMIAGGIGVTPMLSTLRELSHEKSDMPIKLIWSYRNKAEAPCLDEIESFRQPLPHFEFVKVATREQSNEKAAVKRLDKEALGNLMPEFKAGSMVMLCGPAEMMSDVRQSLRYLGYPDSVILSEEFAF

SEQ ID NO: 312 - protein, 417 aa, Accumulibacter phosphatis UW-1
MSLLRRSSIPLLLLASTAGPVYWAFPEGLSPARSLGIVLGWAGCGLLLASLLLMLRETWLSRWLGGLERMYQWHHLVGMAAYVLLLAHPLVLAADAWPASPVLAWQTLSPFSQGWPVRLGWLSLLLLMLGLAATFATRLPHRSWRWLHVSLGVGVLVGLWHLLQLGIEEPVLPILALAALFLGWRILREDSGLAARPYIVQSATPVADGMVEIALKPLAEPIAATAGQFVLVAFFAGPTFRGCGEFHPFTVSSIGADREIRVGVKALGDCTRRIQSIEPGVLARVHGAFGTFLAERPAAPQLWLAGGIGITPFLALLRTGPLSQETTLVYLYRAEADAAFLQELRALAARDPHLSLQAVATGNEPPNLDSLLPTAGELVQHECYLCGPPGMLAAVRQSLHKRGITPRHIHFENFGFR

SEQ ID NO: 313 - protein, 494 aa, Alkalilimnicola ehrlichii ATCC BAA-1101
MSRDAAASHRSATQAPPYLIPALLGLYTLFALLPLLLADTGAGVGLHFWHKLGNGLAMAGFALLLAEFILSGRFRGVTAPIGIDVTLRFHQLMGHTVLVLLLIHPYLYALIPAATQAPGVVVPAPSSGLAEGLTGVIAWLVLGTVVLLAIARDMIGLGYERWRLVHGVGAAVVAVFGLHHTLEAGVYSGQGLLAAFWVLAVAAALFTLVHAYWLVPRRQARAAWRIKAVEQSGPGYWDVTVEPEADSQARQFRFHAGQFAWLKVAGHPYTLKEHPFSIASSPAALPEVVFTIKEAGDFTNTVGELQPGQRAYLDGPHGHFVLDDRPAAGIMLIAGGVGIAPIMSLLRELRAQGEQRPVRLVYGVRRLEEALFREELAAAEEAMDLQVFLVVDEPGDEPVDDPKVLRGPVTREVLHHCLPERGAADWVHYICGPPAMIDSVENSLEAEQVPLEHIRSERFRYTYHASTRRSRRIMAVWAGVTAIVVVAVLLFALV

SEQ ID NO: 314 - protein, 443 aa, Vibrio mimicus VM573
MSRVKYTLWVMVGIVTLLWVQAEPTLFGSTNLFQWRSGLVQFSGILALMLMSLAMLLALRLPLIEQWTQGIDKGYRIHKWLGISALLLGIFHWLAYHLPKWLISLELLTKPARLNGSGPHGNLSGLALWLKEAKPLAMEIGEWGFYALIGLLAISLWSAIKYKPFRFTHRMMAVVYLAVAFHAIVLLKKAYWGEPIYWLTLLFILVGSWAAIYSLLGLVGRQSRYPAHVEAFHYCSQSKTLDLTIQLDKPWQGHKAGQFAYLRFSGEEPHPFTIACAHHGSQLRFLIKELGDFTTGLHERLQNGESLEVEGPYGKFDFAANQPQIWIGGGVGIAPFMAGLDWLTMERSHPQVHLFFCCHQIDPNLCAELRHKAQLAGVSLTIIDSSVDPHLSADDIARRCGDLSRFEFYFCGPVAFSNSLKKALKPYRVDLSRQFHEEQFVMR

SEQ ID NO: 315 - protein, 443 aa, Vibrio mimicus VM603
MSRVKYTLWVMVGIVTLLWVQAEPTLFGSTNLFQWRSGLVQFSGILALMLMSLAMLLALRLPLIEQWTQGIDKGYRIHKWLGISALLLGIFHWLAYHLPKWLISLELLTKPARLNGSGPHGNLSGLALWLKEAKPLAMEIGEWGFYALIGLLAISLWSAIKYKPFRFTHRMMAVVYLAVAFHAIVLLKKAYWGEPIYWLTLLFILVGSWAALYSLLGLVGRQSRYPAHVEAFHYCSQSKTLDLTIQLDKPWQGHKAGQFAYLRFPGEEPHPFTIACAHHGSQLRFLIKELGDFTTGLHERLQNGESLEVEGPYGKFDFVANQPQIWIGGGVGIAPFMAGLDWLTMERSHPQVHLFFCCHQIDPNLCAELRHKAQLAGVSLTIIDSSVDPHLSADDIARRCGDLSRFEIYFCGPIAFSNSLKKALKPYRVDLSHQFHEEQFVMR

SEQ ID NO: 316 - protein, 443 aa, Vibrio cholerae 12129
MSRVKYTLWVMVGIVTLLWVQAEPTLFGSTNLFQWRSGLVQFSGILALMLMSLAMLLALRLPLIEQWTQGIDKGYRIHKWLGISALLLGIFHWLAYHLPKWLISLELLTKPARLNGSGPNSNLSGLALWLKEAKPLAMEIGEWGFYALIVLLVVSLWSAIKYKPFRLTHRLMAVVYLLIALHSVILLKKAYWGEPIYWLTMLFIVVGSWAACYSLLGLVGRQSRYPAHVKAFHYCPNSQTLDLTIQLDKPWLGHKAGQFAYLKFAGEEPHPFTIACAHQGSQLRFLIKELGDFTTGLHQRLQNGESLEVEGPYGKFDFSTQQPQIWIGGGVGIAPFMAGLDWLMTERAHPPVHLFFCCHQIDPNLCAELRHKAQLAGVSLTIIDSSVDPHLSADDIARRCGDLSRFEIYFCGPIAFSNSLKKALKPYQVDLSRQFHEEQFVMR

SEQ ID NO: 317 - protein, 443 aa, Vibrio mimicus CAIM 1883
MSRVKYTLWVMVGIVTLLWVQAEPTLFGSTNLFQWRSGLVQFSGILALMLMSLAMLLALRLPLIEQWTQGIDKGYRIHKWLGISALLLGIFHWLAYHVPKWLISLELLTKPARLNGSGPHGNLSGLALWLKEAKPLAMEIGEWGFYALIGLLAISLWSAIKYKPFRFTHRMMAVVYLAVAFHAIALLKKAYWGEPIYWLTLLFTLVGSWAALYSLLGLVGRQSRYPAHVEAFHYCSQSKTLDLTIQLDKPWQGHKAGQFAYLRFSGEEPHPFTIACAHHGSQLRFLIKELGDFTTGLHERLQNGESLEVEGPYGKFDFAANQPQIWIGGGVGIAPFMAGLDWLTMERSHPQVHLFFCCHQIDPNLCAELRHKAQLAGVSLTIIDSSVDPHLSADDIARRCGDLSRFEFYFCGPVAFSNSLKKALKPYRVDLSRQFHEEQFVMR

SEQ ID NO: 318 - protein, 443 aa, Vibrio mimicus CAIM 602
MSRVKYTLWVMVGIVTLLWVQAEPTLFGSTNLFQWRSGLVQFSGILALMLMSLAMLLALRLPLIEQWTQGIDKGYRIHKWLGISALLLGIFHWLAYHVPKWLISLELLTKPARLNGSGPHGNLSGLALWLKEAKPLAMEIGEWGFYALISLLAISLWSAIKYKPFRFTHRMMAVVYLAVAFHAIVLLKKAYWGEPIYWLTLLFILVGSWAALYSLLGLVGRQSRYPAHVEAFHYCSQSKTLDLTIQLDKPWQGHKAGQFAYLRFPGEEPHPFTIACAHHGSQLRFLIKELGDFTTGLHERLQNGEPLEVEGPYGKFDFVANQPQIWIGGGVGIAPFMAGLDWLTMERSHPHVHLFFCCHQIDPNLCAELRHKAQLAGVSLTIIDSSVDPHLSADDIARRCGDLSRFEIYFCGPIAFSNSLKKALKPYRVDLSRQFHEEQFVMR

SEQ ID NO: 319 - protein, 443 aa, Vibrio mimicus VM223
MSRVKYTLWVMVGIVTLLWVQAEPTLFGSTNLFQWRSGLVQFSGILALMLMSLAMLLALRLPMIEQWTQGIDKGYRIHKWLGISALLLGIFHWLAYHLPKWLISLELLTKPARLNGSGPHGNLSGLALWLKEAKSLAMEIGEWGFYALIGLLAISLWSAIKYKPFRFTHRMMAVVYLAVAFHAIVLLKKAYWGEPIYWLTLLFIAVGSWAALYSLLSLVGRQSRYPAHVEALHYCVKSQTLDLTIQLDKPWQGHKAGQFAYLRFSGEEPHPFTIACANQGSQLRFLIKELGDFTTGLHDRLRHGDTLEVEGPYGKFDFAASQPQIWIGGGVGIAPFMAGLDWLTTERSHPQVHLFFCCHQIDPNLCAELRHKAQLAGVSLTIIDSSVDPHLSADDIARRCGDLSRFEFYFCGPIAFSNSLKKALKPYRVDLSRQFHEEQFVMR

SEQ ID NO: 320 - protein, 443 aa, Vibrio cholerae HC-40A1
MSRVKYTLWVVVGIVTLLWVQAEPTLFGSTNLFQWRSGLVQFSGILALMLMSLAMLLALRLPLIEQWTQGIDKGYRIHKWLGISALLLGIFHWLAYHLPKWLISLELLTKPARLNGSGPNSNLSGLALWLKEAKPLAMEIGEWGFYALIVLLVVSLWSAIKYKPFRLTHRLMAVVYLLIALHSVILLKKAYWGEPIYWLTMLFIVVGSWAACYSLLGLVGRQSRYPAHVKAFHYCPNSQTLDLTIQLDKPWLGHKAGQFAYLKFAGEEPHPFTIACAHQGSQLRFLIKELGDFTTGLHQRLQNGKSLEVEGPYGKFDFSTQQPQIWIGGGVGIAPFMAGLDWLMRERAHPPVHLFFCCHQIDPDLCAELRHKAQLAGVSLTIIDSSVDPHLSADDIARRCGDLSRFEIYFCGPIAFSNSLKKALKPYQVDLSRQFHEEQFVMR

SEQ ID NO: 321 - protein, 443 aa, Vibrio cholerae RC385
MSRVKYTLWVVVGIVTLLWVQAEPTLFGSTNLFQWRSGLVQFSGILALMLMSLAMLLALRLPSVEHWTRGIDKGYRIHKWIGISALLLGILHWLAYQIPKWLISLELLTKPARLNGSGPNSNLSGLALWLKEAKPLAMEIGEWGFYALIVLLVVSLWSAIKYKPFRLTHRLMAVVYLLIALHSVILLKKAYWGEPIYWLTMLFIVVGSWAACYSLLGLVGRQSRYPAHVEAFYYCPNSQTLDLTIQLDKPWLGHKAGQFAYLKFAGEEPHPFTIACAHQGSQLRFLIKELGDFTTGLHQRLQNGESLEVEGPYGKFDFSTQQPQIWIGGGVGIAPFMAGLDWLMTERAHPPVHLFFCCHQIDPNLCAELRHKAQLAGVSLTIIDSSVDPHLSADDIARRCGDLSRFEIYFCGPIAFSNSLKKALKPYQVDLSRQFHEEQFVMR

SEQ ID NO: 322 - protein, 443 aa, Vibrio cholerae PS15
MSRVKYTLWVVVGIVTLLWVQAEPTLFGSTNLFQWRSGLVQFSGILALMLMSLAMLLALRLPSVERWTCGIDKGYRIHKWIGISALLLGILHWLAYQIPKWLISLELLTKPARLNGSGPNSNLSGLALWLKEAKSLAMEIGEWGFYALIVLLVVSLWSAIKYKPFRLTHRLMAVVYLLIALHSVILLKKAYWDEPIYWLTMLFIVVGSWSACYSLLGLVGRQSRYPAHVEAFYYCPNSQTLDLTIQLDKPWLGHKAGQFAYLKFAGEEPHPFTIACAHQGSQLRFLIKELGDFTTGLHQRLQNGESLEVEGPYGKFDFSTQQPQIWIGGGVGIAPFMAGLDWLMTERAHPPVHLFFCCHQIDPNLCAELRHKAQLAGVSLTIIDSSVDPHLSADDIARRCGDLSRFEIYFCGPTAFSNSLKKALKPYQVDLSRQFHEEQFVMR

SEQ ID NO: 323 - protein, 443 aa, Vibrio cholerae HE-16
MSRVKYTLWVVVGIVTLLWVQAEPTLFGSTNLFQWRSGLVQFSGILALMLMSLAMLLALRLPSVERWTRGIDKGYRIHKWIGISALLLGILHWLAYQIPKWLISLELLTKPARLNGSGPNSNLSGLALWLKEAKPLAMEIGEWGFYALIVLLVVSLWSAIKYKPFRLTHRLMAVVYLLIALHSVILLKKAYWGEPIYWLTMLFIVVGSWAACYSLLGLVGRQSRYPAHVEAFHYCPNSQTLDLTIQLDKPWLGHKAGQFAYLKFAGEEPHPFTIACAHQGSQLRFLIKELGDFTTGLHQRLQNGESLEVEGPYGKFDFSTQQPQIWIGGGVGIAPFMAGLDWLMTERAHPPVHLFFCCHQIDPDLCAELRHKAQLAGVSLTIIDSSVDPHLSADDIARRCGDLSRFEIYFCGPIAFSNSLKKSLKPYQVDLSRQFHEEQFVMR

SEQ ID NO: 324 - protein, 443 aa, Vibrio cholerae HE-09
MSRVKYTLWVVVGIVTLLWVQAEPTLFGSTNLFQWRSGLVQFSGILALMLMSLAMLLALRLPSVERWTRGIDKGYRIHKWIGISALLLGILHWLAYQIPKWLISLELLTKPARLNGSGPNSNLSGLALWLKEAKPLAMEIGEWGFYALIVLLVVSLWSAIKYKPFRLTHRLMAVVYLLIALHSVILLKKAYWGEPIYWLTMLFIVVGSWAACYSLLGLVGRQSRYPAHVEAFHYCPNSQTLDLTIQLDKPWLGHKAGQFAYLKFAGEEPHPFTIACAHQGSQLRFLIKELGDFTTGLHQRLQNGESLEVEGPYGKFDFSTQQPQIWIGGGVGIAPFMAGLDWLMTERAHPPVHLFFCCHQIDPNLCAELRHKAQLAGVSLTIIDSSVDPHLSADDIARRCGDLSRFEIYFCGPIAFSNSLKKALKPYQVDLSRQFHEEQFVMR

SEQ ID NO: 325 - protein, 443 aa, Vibrio cholerae TM 11079-80
MSRVKYTLWVVVGIVTLLWVQAEPTLFGSTNLFQWRSGLVQFSGILALMLMSLAMLLALRLPSVERWTRGIDKGYRIHKWIGISALLLGIWHWLAYQIPKWLISLELLTKPARLNGSGPNSNLSGLALWLKEAKPLAMEIGEWGFYALIVLLVVSLWSAIKYKPFRLTHRLMAVVYLLIALHSVILLKKAYWGEPIYWLTMLFIVVGSWAACYSLLGLVGRQSRYPAHVEAFHYCPNSQTLDLTIQLDKPWLGHKAGQFAYLKFAGEEPHPFTIACAHQGSQLRFLIKELGDFTTGLHQRLQNGESLEVEGPYGKFDFSTQQPQIWIGGGVGIAPFMAGLDWLMTERAHPPVHLFFCCHQIDPNLCAELRHKAQLAGVSLTIIDSSVDPHLSADDIARRCGDLSRFEIYFCGPIAFSNSLKKALKPYQVDLSRQFHEEQFVMR

SEQ ID NO: 326 - protein, 443 aa, Vibrio cholerae HC-52A1
MSRVKYTLWVVVGIVTLLWVQAEPTLFGSTNLFQWRSGLVQFSGILALMLMSLAMLLALRLTSVERWTRGIDKGYRIHKWIGISALLLGILHWLAYQIPKWLISLELLTKPARLNGSGPNSNLSGLALWLKEAKPLAMEIGEWGFYALILLLVVSLWSAIKYKPFRLTHRLMAVVYLLIALHSVILLKKAYWGEPIYWLTMLFIVVGSWAACYSLLGLVGRQSRYPAHVKAFHYCPNSQTLDLTIQLDKPWLGHKAGQFAYLKFAGEEPHPFTIACAHQGSQLRFLIKELGDFTTGLHQRLQNGKSLEVEGPYGKFDFSTQQPQIWIGGGVGIAPFMAGLDWLMTERAHPPVHLFFCCHQIDPNLCAELRHKAQLAGVSLTIIDSSVDPHLSADDIARRCGDLSRFEIYFCGPIAFSNSLKKALKPYQVDLSRQFHEEQFVMR

SEQ ID NO: 327 - protein, 443 aa, Vibrio cholerae CP1035
MSRVKYTLWVVVGIVTLLWVQAEPTLFGSTNLFQWRSGLVQFSGILALMLMSLAMLLALRLTSVERWTRGIDKGYRIHKWIGISALLLGILHWLAYQIPKWLISLELLTKPARLNGSGPNSNLSGLALWLKEAKPLAMEIGEWGFYALIVLLVVSLWSAIKYKPFRLTHRLMAVVYLLIALHSVILLKKAYWGEPIYWLTMLLIVVGSWAACYSLLGLVGRQSRYPAHVKAFHYCPNSQTLDLTIQLDKPWLGHKAGQFAYLKFAGEEPHPFTIACAHQGSQLRFLIKELGDFTTGLHQRLQNGESLEVEGPYGKFDFSTQQPQIWIGGGVGIAPFMAGLDWLMTERAHPPVHLFFCCHQIDPNLCAELRHKAQLAGVSLTIIDSSVDPHLSADDIARRCGDLSRFEIYFCGPIAFSNSLKKALKPYQVDLSRQFHEEQFVMR

SEQ ID NO: 328 - protein, 443 aa, Vibrio cholerae HC-56A1
MSRVKYTLWVVVGIVTLLWVQAEPTLFGSTNLFQWRSGLVQFSGILALMLMSLAMLLALRLTSVERWTRGIDKGYRIHKWIGISALLLGILHWLAYQIPKWLISLELLTNPARLNGSGPNSNLSGLALWLKEAKPLAMEIGEWGFYALILLLVVSLWSAIKYKPFRLTHRLMAVVYLLIALHSVILLKKAYWGEPIYWLTMLFIVVGSWAACYSLLGLVGRQSRYPAHVKAFHYCPNSQTLDLTIQLDKPWLGHKAGQFAYLKFAGEEPHPFTIACAHQGSQLRFLIKELGDFTTGLHQRLQNGKSLEVEGPYGKFDFSTQQPQIWIGGGVGIAPFMAGLDWLMTERAHPPVHLFFCCHQIDPNLCAELRHKAQLAGVSLTIIDSSVDPHLSADDIARRCGDLSRFEIYFCGPIAFSNSLKKALKPYQVDLSRQFHEEQFVMR

SEQ ID NO: 329 - protein, 443 aa, Vibrio cholerae HE-45
MSRVKYTLWVVVGIVTLLWVQVEPTLFGSTNLFQWRSGLVQFSGILALMLMSLAMLLALRLPSVERWTRGIDKGYRIHKWIGISALLLGILHWLAYQIPKWLISLELLTKPARLNGSGPNSNLSGLALWLKEAKPLAMEIGEWGFYALIVLLMVSLWSAIKYKPFRLTHRLMAVVYLLIALHSVILLKKAYWGEPIYWLTMLFVVVGSWAACYSLLGLVGRQSRYPAHVEAFHYCPNSQTLDLTIQLDKPWLGHKAGQFAYLKFAGEEPHPFTIACAHQGSQLRFLIKELGDFTTGLHQRLQNGESLEVEGPYGKFDFSTQQPQIWIGGGVGIAPFMAGLDWLMTERAHPPVHLFFCCHQIDPNLCAELRHKAQLAGVSLTIIDSSVDPHLSADDIARRCGDLSRFEIYFCGPIAFSNSLKKALKPYQVDLSRQFHEEQFVMR

SEQ ID NO: 330 - protein, 421 aa, Rhodopseudomonas palustris DX-1
MSTAGSASRRWSIPLLTLAVPVGFAVWAFPEGLAPLRVAGIVTGWLGCGLLLVSLLLMLREPRLAAWLGGLERMYRWHHVTGVAAYVLLLLHPLALAANNWSSSPKVAWQTLSPSTESWQVWSGWLGLLLLMVGLATTFVRRIRYGTWRWLHALLGLGVLIGLVHLILLGIDEPVVPILAVAGAILGWRLIRGDLGLGARPYLVTSARPLAERSVEIALRPLGEPAIVFPGQFVLVEFGDGRRYRGCGEFHPFTVSAIRAGNELHLAIKALGDCTSKMLAIEAGVAARVIGGFGGLIEPRDAGPQLWIAGGIGVTPFMAVLNAGPLLQPSRLLYLYRTEADAAFLPELRAAASAEPNLTLHCAATGDDLPDLDKLLPDASRLSGTECYLCGPPGLVAALKSVLAARGVAARHVHYENFEFR

SEQ ID NO: 331 - protein, 507 aa, Citreicella sp. 357
MTDAVHRAGDVPAPGFPTLPRLPVMSPLPMMGPLLVALPCLLAALLGFNTHAPYGADAALGIAVGAAAVVAMAQTLILAARPPLVEPLFGGLDRMYRVHKWLGISAMVLMILHQQIEPDFERTVRETGLGGLGAEAGELAFNALLALIAVSWFRRLPFIGLEIPYQIWRFSHRFMGALFAIVVFHQFFVDMPTGVDPSLSMLLNTFGIAGVAAWIFTELVAPQLRRREFTVSEISHTGDTTTLKLSPKGRAMRWRPGQFAFVRAPEAGLSEPHPFTIASAPRPDGALTFSIRALGGWTRSLPATLRTGTRVQVEGPYGRFDFRKGGARQIWLADGIGITPFLAWAESLTEAERRDIHLVHCVRTQEQAIGLETLRAAAARNPRFSFEVVVTTRDGRRTAERLISAAPFAGKDADLWFCGPTGLKDGILKDRTRCRGGSASSSSNLPEKGPVTSPRQPCGSRLRLLAPLSPAGPFLPDGNLKRKSLRLQQALRSVLQIVFSRRKETLP

SEQ ID NO: 332 - protein, 434 aa, Aeromonas veronii AER39
MTGKRMWWLLPLLAVGVWWLGYAGDANGVWPWRHEMLLLTGLLGMTYMAISLLLALRLPQLELWCGGLDRMLRLHRQTAIGGALALTAHWLLVEAPKWAVSAGWLSRPARRGASGVGAGAGAGAGNGISLHALGNTLGEWSFYLLIALVVVSLLALVSYGRFRLIHRLAPIIYLAGWGHGLCLLPQVGAMTPVGISIWLVGGMGAIGALYSLLGQVGARDRHPGRIIAVRALADQTCELTMQLERPLAHYRPGQFAFFEFDAKEGPHPFTLVRVSADRRQLVIAVRALGDHTRQLVAQARAGDEVVVTGPYGAFVAPQRGGRALWLGAGIGITPFVAWLESLAAQGGRGEGITLIQCAPDMAGAVYHQRLAELCHRTGVSYQLHLDKVEGRLDLARVAQRASGSVWFCGPEGMADALTRLLPDGRLHRELFRFR

SEQ ID NO: 333 - protein, 432 aa, Aeromonas veronii AMC34
MTGKRVWWLLPLLAVGVWWLGYAGDANGAWPWRHEMLLLTGLLGMAYMTISLLLALRLPQLEVWCGGLDRMLRLHRQTAVGGALVLTAHWLLVEAPKWAVSAGWLSRPARRGASAAEVGAGAGNGISLHALGNTLGEWSFYLLIALVVLSLLALVSYGRFRLIHRLAPLIYLAGWCHGLCLLPQIGTMTPVGVSIWFVGGLGAIGALYSLLGQVGARERHPGRVVAVRALADHTCELTMQLERPLAHYRPGQFAFFEFDAKEGSHPFTLVRVSADRRQLVIAVRALGDHTRQLVAEARVGDGVVVTGPYGAFVAPQRGGRALWLGAGIGITPFVAWLEGLAARGEHGEGITLIQCAPDLAGAVYHQRLAELCHRTGVRYQLHLDKAAGRLDMARIAQDAPEQVWFCGPEGMADALARLLPDGHLHRELFRFR

SEQ ID NO: 334 - protein, 425 aa, Rhodopseudomonas palustris BisB18
MTGLASTLRLLSIPLLSVAVPFGFVLWAFPEDLAPARMIGIVVGWIGCGLLLVSLLLMLREPRLARWLGGLERMYRWHHVTGILAYVALLLHPLALAANGLSTSPAFAWETLSAFDEGWAVWSGWLGLLVLMLGLIVTFSPTLNQRLSYGTWRWLHAALALGVLLGLVHLVLLGIDEPVLPIIAVVALILAWRALRGDLGLAAHPYIVSSVQPIAEGAVEIGLRPLGDPLAIAAGQFVLVAFFAGPTYRGCGEFHPFTVSSIDPDRVLHVGVKALGDCTRRMLSIEQGVAARVMGGFGNFLADRKAAPQFWVAGGIGVAPFVALLRAGHLSDATRLLYLYRSEADAVFLSELRTIAASDPRLSLQAVATGDTLPDLTQILPDASQLSGCDCYFCGPPGLIAALEPLLRAKGVTARHIHYENFEFR

SEQ ID NO: 335 - protein, 461 aa, Streptomyces griseoflavus Tu4000
MTKLGVPGPDQGVSGVTAVHSPPSPPTARRRPETVARTGLYALLAANALVVAVLFVRAGFGANALVVLGRLTGLYAGLLMAFQLLLVARLPWLDRRIGMDRLTLWHRWTGFGLLWALLAHVVFITFGYADMSSLDPVDQLVDLAGTVEGVLRAVVALALILVVGAVSARRARRRLAYETWHFIHLYSYAAVVLAFSHQVAVGSTFTASPAATAYWWGLWGAALTAVLTGRLVLPLGRNRRHRLRVTAVVPENDQVVSVHITGRDLHRLPARAGQFFLWRFLTRDRWWQAHPFSLSAAPDGRTLRLTVKAAGDGSAALRRLRPGTRVFAEGPYGAFTTLRRTRPDTLLIAGGVGVTPIRALLEELDGHAVVLYRVRTEADAVLLGELRALALAKGAELHLVTGPAAPDRLAPAELSRLVPDLTGRDVYVCGPPGMTTAVLRSLRALGVPKRQIHHERFSLAG

SEQ ID NO: 336 - protein, 417 aa, Aeromonas salmonicida subsp. salmonicida 01-B526
MTKNKFANEMIIRNGARCSWQYRLRDLLILLVTWIGWLLLALRLPRLEVWCGGLDRMLRLHRHSAMAATLALTSHWLLVEAPKWAVTAGWLTRPARRGAGGGAGAGAGNGFSLHALGNTLGEWSFYLLIALVVVSLLSLVSYGRFRVIHRLAPLIYLAGWVHGLCLLPQVGLLTPVGLGISLLGGAGAVAAVYSLLGLTGQRDRHQGRIVALRTLADSTREFTLQLATPLSHYRPGQFAFFEFDAKEGPHPFTLVRVSPDKRQLVIAVRALGDHTRQLVEAARVDGPVTVTGPYGAFVCPARQGQSLWLGAGIGITPFVAWLEGLVVRGERGEGITLIQCAPDLAGAVYHQRLAELCQRTGVRYRLHLDKEAGRLDLAGLAQGKPGDVWFCGPERMADALTRLLPGGRLHRELFRFR

SEQ ID NO: 337 - protein, 344 aa, Escherichia coli 576-1
MTLTMCLSLRSSWLNKVLGGLDKAWRLHKWAGICAIAFAFAHWLDEKLPQLFVAFGWLTHPGKIVDINLTPVQENWLHAGLLVGECAMFIMIAMIFVSLSKKVPYHLFHLVHRLFPVFYLAIAFHVFTALFKSYWWETPAAYLLILITIPGVFAAFISLLKLNGSKNKHQATIKNIVNHPGQITEVTLELEHAIDYSPGQFAFLTFAHSKESHPFTIASYTKEKNTLRFAIKHLGDYTSTLASSIKIGQSAFVEGPWGKFDFTLPCSHQVWIAGGIGITPFIAQLEYRKHHGASFVPVDLWYCVSRSEDAWYIDKLTSLCAQARVTLHLLDAHKGERLQVHYLT

SEQ ID NO: 338 - protein, 389 aa, Escherichia coli PCN033
MTLTMCLSLRSSWLNKVLGGLDKAWRLHKWAGICAIAFAFAHWLDEKLPQLFVAFGWLTHPGKIVDINLTPVQENWLHAGLLVGECAMFIMIAMIFVSLSKKVPYHLFHLVHRLFPVFYLAIAFHVFTALFKSYWWETPAAYLLILITIPGVFAAFISLLKLNGSKNKHQATIKNIVNHPGQITEVTLELEHAIDYSPGQFAFLTFAHSKESHPFTIASYTKEKNTLRFAIKHLGDYTSTLASSIKIGQSAFVEGPWGKFDFTLPCSHQVWIAGGIGITPFIAQLEYRKHHGASFVPVDLWYCVSRSEDAWYIDKLTSLCAQARVTLHLLDAHKGERLQVHYLTDKIANKGDTHFWFCGPQSFAKALSKGLYENGIASQNFHFDRFCMR

SEQ ID NO: 339 - protein, 430 aa, Aeromonas veronii AMC35
MTNKWMWWLLPLLAVGVWWLGYAGDANGVWPWHHEMLLLTGLLGMAYMAISLLLALRLPQLEVWCGGLDRMLRLHRQMAIGGALALTAHWLVVEAPKWAVSAGWLSRPARRGASGAGAGAGNGISLHALGNTLGEWSFYLLIALVVVSLLALVSYGRFRLIHRLAPIIYLAGWGHGLCLLPQIGAMTPVGVAIWLIGGIGAIGALYSLLGQVGARKRHPGRVVAVRTLADQTCELTMQLERPLAHYRPGQFAFFEFDAKEGPHPFTLVRVSADRRQLVIAVRALGDHTRQLVAEARAGDGVVVTGPYGAFVAPQGGGRALWLGAGIGITPFVAWLEGLAARGERGEGITLIQCTPDLAGAVYHQRLAELCHRTGVRYQLHLDKAAGRLDLARIAQDAPEQVWFCGPEGMADALTRLLPDGHLHRELFRFR

SEQ ID NO: 340 - protein, 430 aa, Aeromonas veronii AER397
MTNKWMWWLLPLLAVGVWWLGYAGDANGVWPWRHEMLLLTGLLGMAYMAISLLLALRLPQLEVWCGGLDRMLRWHRQTAIGGALALTAHWLLVEAPKWAVSAGLLSRPARRGASGAGAGAGNGISLHALGNTLGEWSFYLLIALVVVSLLALVSYGRFRLIHRLAPLIYLVGWGHGLCLLPQVGAMTPVGVSIWLIGGIGAIGALYSLLGQVGARDRHPGRVIAVRALADQTCELTMQLERSLAHYRPGQFAFFEFDAKEGPHPFTLVRVSADRRQLVIAVRALGDHTRQLVAEARVGDGVVVTGPYGAFVAPQGGGRALWLGAGIGITPFVAWLEGLAARGERGEGITLIQCAPDLAGAVYHQRLVELCHRTGVRYQLHLDKAAGRLELARIAQDAPEQVWFCGPEGMADALTRLLPDGHLHRELFRFR

SEQ ID NO: 341 - protein, 432 aa, Aeromonas veronii Hm21
MTNKWMWWLLPLLAVGVWWLGYAGDANGVWPWRHEMLLLTGLLGMTYMAISLLLALRLPQLEVWCGGLDRMLRLHRQTAIGGALALTAHWLVVEAPKWAVSAGWLSRPARRGASAAAAGASAGNGISFHALGNTLGEWSFYLLIALVVVSLLALVSYGRFRLIHRLAPLIYLAGWGHGLCLLPQIGAMTPVGVSIWLIGGLGAIGALYSLLGQVGARDRHPGRVIAVRALADHTCELTMQLERLLAHYRPGQFAFFEFDAKEGPHPFTLVRVSADRRQLVIAVRALGDHTRQLVAKARVGDGVVVTGPYGAFVAPQRGGRALWLGAGIGITPFVAWLEGLAARGERGEGITLIQCAPDLAGAVYHQRLVELCHRTGVRYQLHLDKAAGRLDLARIAQDAPEQVWFCGPEGMADALTRLLPDGHLHRELFRFR

SEQ ID NO: 342 - protein, 428 aa, Glaciecola nitratireducens JCM 12485
MTNLRLRLSLLLLLALQLSIWQWGLSYEHFLTLSGFLAINFMSITMILATRPAYLERILGGLDKMYHLHKWTGILAVIFALGHWLIEMADDVLKTLFGKDRSLRESDFTGLLDDMQDMAEDLGEPSLYLLIALVTITLVRWIPYRFWRYLHRVMPLIYIALASHALLLAPMVWWQQATGWLMAVLMMGGIIATVQSLTGQIGRTHRWKGLVQSVKQASKNTIEVFCDMGKCWPGHKAGQFALVSFDSGEGAHPFTLSSADQKNGLLSFQIKALGDYTRTLANDINSGSKVTIEGPYGRFQPENGRAKAQQIWVAGGIGVTPFLAVLENRMYMRKEKYPEVTLHYCTQTVQGDPNVLRLKNLAENLPQITLIVYDNRKGQRLNAEQLQIHSKKADIWFCGPQGLAGALRKALKNHQASVRFHQERFEFR

SEQ ID NO: 343 - protein, 471 aa, Micromonospora aurantiaca ATCC 27029
MTYQDTRAAGRRTGHPAPYGGRPAAPVPPGRPRRGPGGRRALAALFWLGLVAAVLPWWLDTPAGSLADTADLLTAGGRITGLLAGYLLLVQVLMMSRLGVLERALGGERISRLHRDLGATLLVAVLAHMSLLVVGYSRQERKTVLGEVGALLTDYEDMVSAFVAAGILVAVAFTAVRAVRRRLPYELWHLLHAASYLTLLLGYAHQFSNGAQLYEPGPVRTGWIAAYLLVVAALVWGRMLAPLVFNLRHRLRVADVVAESPDTVSVYLTGQRLNQIDLLGGQFFRWRFLNPGCWWQSHPFSVSAAANDRWLRITVKVVGGYTAELRDLTPGTRVWAQGPSGTFTAAHRTRERALLIAGGSGIAPLRAMLEELPPGAALIYRARTPADVLLHQELDWLAQARQTSVWYVVGRRDDPGPRQVMNPEGLRRLVPDLTRRDVYLCGPGGLVDEAVAALRAAGVPRRQIHLTAFEL

SEQ ID NO: 344 - protein, 420 aa, Rhodopseudomonas palustris TIE-1
MVAAAAALRRWSIPLLSCAVPAGFAVWAFPEGLAPVRAAGIITGWLGCGLLLVSLLLMLREPRLAAWLGGLERMYRWHHATGLAAYLFLLLHPLLLAANNLSSPRVAWQTLSPFTESWPVWSGWLGLLLLMGGLVTTFIRRIRYGTWRWLHALLGLGVLTGLVHLILLGIDEPVLPILAVAAGILGWRLIRGDLGLAARPYVVTSALPLAARSIEVVLRPLGDPAMVTPGQFVLVEFGNGDCYRGCGEFHPFTVSTIAGQDELHLAVKALGDCTTRMQAIEPGVAARVIGGFGGFVDSHGRAPQFWVAGGIGVTPFVALLNAGPLLHPTRLLYLYRCEADAAFLPELRATAAADPKFTLHAVETGDGVPDLGPLLPPAGELSGAECYLCGPPGLVAALKSALAARGVTAQHVHYENFEFR

SEQ ID NO: 345 - protein, 420 aa, Rhodopseudomonas palustris ATCC BAA-98
MVAAAAALRRWSIPLLSCAVPAGFAVWAFPEGLAPVRAAGIITGWLGCGLLLVSLLLMLREPRLAAWLGGLERMYRWHHATGLAAYLFLLLHPLLLAANNLSSPRVAWQTLSPFTESWPVWSGWLGLLLLMGGLVTTFIRRIRYGTWRWLHALLGLGVLTGLVHLILLGIDEPVLPILAVAAGILGWRLIRGDLGLAARPYVVTSALPLAARSIEVVLRPLGDPAMVTPGQFVLVEFGNGDRYRGCGEFHPFTVSTIAGQDELHLAVKALGDCTTRMQAIEPGVAARVIGGFGGFVDPHGRAPQFWVAGGIGVTPFVALLNAGPLLHPTRLLYLYHCEADAAFLPELRATAAADPKFTLHAVETGDGVPDLGPLLPPAGELSGAECYLCGPPGLVAALKSALAARGVTAQHVHYENFEFR

SEQ ID NO: 346 - protein, 433 aa, Vibrio mimicus SX-4
MVGIVTLLWVQAEPTLFGSTNLFQWRSGLVQFSGILALMLMSLAMLLALRLPLIEQWTQGIDKGYRIHKWLGISALLLGIFHWLAYHLPKWLISLELLTKPARLNGSGPHGNLSGLALWLKEAKPLAMEIGEWGFYALIGLLAISLWSAIKYKPFRFTHRMMAVVYLAVAFHAIVLLKKAYWGEPIYWLTLLFILVGSWAAIYSLLGLVGRQSRYPAHVEAFHYCSQSKTLDLTIQLDKPWQGHKAGQFAYLRFSGEEPHPFTIACAHHGSQLRFLIKELGDFTTGLHERLQNGESLEVEGPYGKFDFAANQPQIWIGGGVGIAPFMAGLDWLTMERSHPQVHLFFCCHQIDPNLCAELRHKAQLAGVSLTIIDSSVDPHLSADDIARRCGDLSRFEFYFCGPVAFSNSLKKALKPYRVDLSRQFHEEQFVMR

SEQ ID NO: 347 - protein, 433 aa, Vibrio cholerae MZO-2
MVGIVTLLWVQAEPTLFGSTNLFQWRSGLVQFSGILALMLMSLAMLLALRLPSVERWTRGIDKGYRIHKWIGISALLLGILHWLAYQIPKWLISLELLTKPARLNGSGPNSNLSGLALWLKEAKPLAMEIGEWGFYALIVLLVVSLWSAIKYKPFRLTHRLMAVVYLLIALHSVILLKKAYWGEPIYWLTMLFIVVGSWAACYSLLGLVGRQSRYPAHVKAFHYCPNSQTLDLTIQLDKPWLGHKAGQFAYLKFAGEEPHPFTIACAHQGSQLRFLIKELGDFTTGLHQRLQNGESLEVEGPYGKFDFSTQQPQIWIGGGVGIAPFMAGLDWLMTERAHPPVHLFFCCYQIDPNLCAELRHKAQLAGVSLTIIDSSVDPHLSADDIARRCGDLSRFEIYFCGPIAFSNSLKKALKPYQVDLSRQFHEEQFVMR

SEQ ID NO: 348 - protein, 447 aa, Vibrio anguillarum ATCC 68554
MVIMMSRVSKTVLIVMVVVSVLWMQAEPTLLVSENLFKWRSAFIQWSGILAIVAMSLAMVLALRLPLVEQWTQGIDKGYRIHKWLGISATLLGLFHWLCYQIPKWMIALELLTKPNRLNGSGPQGNLSGFALWVKEMRPIGLAIGEWGFYSLLLLVGVSLWLTIKYKPFRLSHRLMAVVYLLLAGHSVLLLKKAYWGWPIYWLVLMFIALGSAAAVYSLLGFVGRNARYSAKVSAYHYCAASQTLDLRIKMEKPWPGHKAGQFAYLSFVGEEPHPFTIASYNEANELRFLIKELGDFTTGLYKRITVGEPIEVEGPYGRFEFYSDRPQVWIGGGVGIAPFMAGLDYLHTVKAHPATYLFFCCHHAEQALCDELKQKALRAGVSLTVIDSSIAPHLSVETIARQCGDLSGFEFFFCGPVAFSRTLKQALKPYHVDVETQFHEELFMMR

SEQ ID NO: 349 - protein, 431 aa, Aeromonas salmonicida subsp. pectinolytica 34mel
MVTKRALWLLPVLAALIWWAGYAGDANGVWPWRHEMLLLTGLLGLGYMALTLLLALRLPRLEVWCGGLDRMLRLHRHSAMAATLALTSHWLLVEAPKWAVTAGWLTRPARRGAGGGAGAGAGNGLSLHALGNTLGEWSFYLLIALVVVSLLSLVSYGRFRVIHRLAPLIYLAGWVHGLCLLPQVGLLTPVGLGISLLGGAGAVAAVYSLLGLTGQRDRHQGRIVALRTLADSTREFTLQLETPLSHYRPGQFAFFEFDAKEGPHPFTLVRVSPDKRQLVIAVRALGDHTRQLVEAARVDGPVTVTGPYGAFVCPARQWQSLWLGAGIGITPFVAWLEGLVARGERGEGITLIQCAPDLAGAVYHQRLSELCQRTGVCYRLHLDKEAGRLDLAGLAQGKPGDVWFCGPEGMADALARLLPGGRLHRELFRFR

SEQ ID NO: 350 - protein, 358 aa, Streptococcus agalactiae FSL S3-251
MYFYHKVMAVFSMILLLLHKIGLGQGGHGSEFAKTIGSAGLYLFLSIVFVAYFGNFLKYEIWRFIHRFVYLAYILGLVHTFMILGDRILGNTLLSLIVLGYAVIGVISGFYIIFLYSRMRFRRVGYVQKVTHLNHDTTEIEITMKRPYRYDYGQFTFLKIYQAGFESAAHPFSISGGHDRVIFLTVKASGDYTKSIYKQLKVGTKIALDRAYGHMLFDKDKKEQVWIAGGIGITPFISFIRENSILTKRVDFFYTFSNQDNLIYQDMLESYAKANPNFKLHLNNSSLQGRLDFSQSVFEGQPTIFMCGPTSMTSTYAKVFRQKDAKSRLVYEGFSFRDSWLSIFLLKTFDKVYSNLIK

SEQ ID NO: 351 - protein, 364 aa, Marinobacter sp. ELB17
MYQLHKWTGIMAVSFALAHWLIEMANDALEALFGSDRSLKEAHFSGLLDSLQDGAEDLGEPGLYLLVFLVVITLIRRVPYGYWRYLHRVMPLIYLALAAHALLLAPLLWWQQPTGWLMALLIVGGATASLQSLTGKIGRSRRYEGLVQAVKQTSANITEVVCDIGKRWSGHRAGQFALVTFDRVEGAHPFSLSCADNATGQLSFQIKALGDYTRKIPQQLHSGQAVTLEGPYGRFNLDSGRKSAQQIWVAGGIGITPFLAALDNRLINNEKRHPAVTLHYCTAGAVNDPMVIRLQQLTEQLPDISLHLYDSLQWQRLTANQLHIHGSKVDVWFCGPQGLAKALRSELKQQSVSLRFHQEIFEFR

SEQ ID NO: 352 - DNA, 1203 bp, Streptococcus pneumoniae
atggaattttctatgaaatcagtcaaaggactactctttatcatagctagttttatcttgactcttttgacttggatgaacacttctccccaattcatgattccaggactagctttaacaagcctatctctgacttttatcctagccactcgtctcccactactagaaagctggtttcacagtttggagaaggtctacaccgtccacaaattcacagcctttctctcaatcatcctactaatctttcataactttagtatgggcggtttgtggggctctcgcttagctgctcagtttggcaatcttgccatctatatctttgccagcatcatccttgtcgcctatttaggcaaatacatccaatacgaagcttggcgatggattcaccgcctggtttacctagcctatattttaggactctttcacatctacatgataatgggcaatcgtctccttacatttaatcttctaagttttcttgttggtagctatgcccttttaggcttactagctggtttttatatcatttttctatatcaaaagatttccttcccctatctagggaaaattacccatctcaaacgcttaaatcacgatactagagaaattcaaatccatcttagcagacctttcaactatcaatcaggacaatttgcctttctaaagattttccaagaaggctttgaaagtgctccgcatcccttttctatctcaggaggtcatggtcaaactctttactttactgttaaaacttcaggcgaccataccaagaatatctatgataatcttcaagccggcagcaaagtaaccctagacagagcttacggacacatgatcatagaagaaggacgagaaaatcaggtttggattgctggaggtattgggatcacccccttcatctcttacatccgtgaacatcctattttagataaacaggttcacttctactatagcttccgtggagatgaaaatgcagtctacctagatttactccgtaactatgctcagaaaaatcctaattttgaactccatctaatcgacagtacgaaagacggctatcttaattttgaacaaaaagaagtgcccgaacatgcaaccgtctatatgtgtggtcctatttctatgatgaaggcacttgccaaacagattaagaaacaaaatccaaaaacagagcttatttacgaaggattcaagttcaaataa

SEQ ID NO: 353 - DNA, 1305 bp, Pseudomonas aeruginosa
atgaaactgttatggggagttctcgccgccgcgctggcggcctggggcctgacgctggccgtcgatccgccggcgagcctggacatctgggtggtgcgcaagcaggcgatcctgcttaccggggtagcgtccttcgccctgatgtcgttgatcatgctgctggcggtgcgtccggtctggctggagaagccgctggacgggctcgaccgcatgtaccgcctgcacaagtgggcgggcatcctggccatcgtcctcggcctgttgcactacctgctggagttggccggcccctggctggcgggtatcgtcggcaaaccggtgaaaggcccgcgggtggaaaccttcctcgatgtcttccgtggctcggccaaggagttgggtgaatggtcggcgtggattctcggcgggatgctgctggtcactctctggcagcgcttcccgtatcacctctggcgttatgtgcacaaggcgttggccctggtctacctggtactggccttccattccgtggtgctcgccccggccagctactggagccagccggccggttggctggtggcggcctgcgctctgctcggttcggcctgcgcactgttgtctctgagcgggcggatcggtcgcacgcgtcgccatgcgggcgtggtcaccgccgtcgagcggcacggcgaaagcctgctcgaggtgacctgccggctgcagggcgactggtcgcacagggccgggcagttcgcctttctcacctgcgaccgcctggagggtgcccatccgttcaccatcgccagcgccgaccgcggctgcggcgaggtgcgcttcagcatcaaggcgttgggcgactacacccggcgcctgcaggacaacctggaggtcggcgccagggtcgaggtggaggggccatacggctgcttcgacttccgccgtggcctggccgggcggcaggtctgggtcgccgccgggatcggcgtgacgccgttcatcgcctggctggagtcgctgcaggccgcgccggaaagcgcgccatcggtggagctgcactattgcgtgcgcaattcccaggaagcgctgttcgccgggcgcttgcgcgagctttgcgaacacctgcccagcgtgaccctgcacatccgctatagcgacgagcagggcaagccgcaggcggcgcaactgggcgtgctgaagagcgccgaaggacgctggccgagcgtctggttctgcggtccgcaggggctggccgacagcctgcgccgcgatctgcgccggcagggcatgccgctgcggctgttccaccaggaagccttccgcatgcgctga

SEQ ID NO: 354 - DNA, 1326 bp, Escherichia coli
atgaaaaaagctaatcttacaggtacgttggtttgctttgtcgcatgccttatttttttgtcgtccggtgatatttttcgtgaaaagccaatcgcgctaatatggttccttcgacaaaacatactcttttttacgggaactcttgcgtggtgtctgatgacgctgacgatgtgtttatcgttgcgttcatcatggcttaacaaagtgctgggcggtctggataaagcatggcgattacataagtgggcaggaatatgcgccatagcgtttgctttcgcccactggctggatgaaaaattaccccagttattcgtcgcctttggctggcttactcaccctggtaaaatcgttgatattaacctgacgccagtacaagaaaattggcttcatgcgggactgttagcgggtgaatgcgcaatgtttattattatagcgatggtttgcgtatctcttagcaaaagagttccctatcatttatttcatcttgttcaccgtttgttccccgtcttttatctggcaattgcctttcatgtgtttactgctttgtttaaatcatactggtgggaaactcctgctgcgtatttattaattttaattactattccgggcgtctttgcggctttcatttcgctgctgaaattaaacggtagtaaaaacaagcatcaggctaccattaaaaacattgttaaccatccaggacaaattaccgaagtcaccctggagctggaacatgccatcgactattctccggggcagtttgcattcttaacgttcgcacacagtaaagaatctcacccttttactatcgcttcatacaccaaagagaagaacacgttgcgctttgccatcaaaaatttaggggattatacctctacccttgcatcctcgataaaaatcggccagtccgccttcgttgaagggccatggggaaagtttgattttactctcccttgctcccaccaggtctggatagcaggaggcatcggcattaccccctttatcgcccagcttgagtatcgtaaacatcatggcgcgtcctctgttcctgtggatatctggtattgcgtcagccgaagcgaggatgcctggtatgttgataaactgacctcactttgtgcccaggccagggtcacactgcatctgcttgatgcgcataaaggtgagcgcctacaggcgcactatcttactgataaaatagcaaataaaggtgacacccatttctggttttgcggcccacagagttttgccaaagcgctcagcaaagggttatatgaaaatgggattgccagccaaaacttccattacgaccgtttttgtatgcgttaa

SEQ ID NO: 355 - DNA, 1215 bp, Vibrio cholerae
gtgcagttctccggtattctggcactcatgctgatgtcgttggcgatgctgttagccttgcgtttacccttgatagaacaatggacgcaagggatagacaaaggctatcgcattcataaatggctcgggatctctgcgctcttacttgggatcttccattggcttgcttaccatcttcctaagtggctcatctcacttgaactactgacgaaacccgcccgccttaatggttctggcccaaatagtaacctatccggtttggctttatggctaaaagaggctaagcctttggcgatggaaatcggggagtggggattctacgccttgattgtgctgttggtggtttcgctttggtcggccattaaatacaaaccgtttcgactgactcaccgcttgatggcggtggtgtatttgttgattgctttgcatagtgtgatcttgctgaaaaaagcctattggggtgagccaatttactggctaacaatgctgtttattgtggtggggtcatgggctgcatgttatagcttgctcggtttggtcggtcgacaatctcgttatccggctcatgttaaggcgtttcattactgccctaacagtcaaaccttggatttaaccattcaattagataagccttggttaggtcacaaggctgggcagtttgcgtacttaaagtttgccggtgaagaaccacatccgttcactatcgcctgtgctcatcagggctcccaacttcgctttttgattaaagagctgggtgattttacaacggggctgcatcagcgcttacaaaacggaaagtctttggaagtcgaaggcccttatggcaagtttgatttttcgactcagcaacctcagatttggatcggtggtggcgttgggattgcgccatttatggctggactcgactggttaatgagggagagagcacacccaccagtacatctttttttctgttgccatcaaattgatccggatttgtgcgcagaacttcgccacaaagcgcagttggctggggtttcattaaccattatagattcgagcgttgatcctcatctgtcagcagatgacattgcgcgccgatgtggagatttaagccgtttcgaaatctatttctgtgggccaatcgcattttccaatagtctgaaaaaagcgcttaaaccttaccaagtggatttgtcacgccagtttcatgaagaacaattcgtgatgcgctag

SEQ ID NO: 356 - DNA, 1317 bp, Salmonella enterica
atgatgcggatgatttttcctttcgttgtgttggttttgggcctatgggcctggaacctctttgcaggtcctggggccggttctccctgggcagtctatgaccagagcctgctgctcagtgggctgttatccattgctctgatgtcactgaccatgatgctggcactgcgcccagcctggttggagagaccgctgggcgggttggatcagatctatcgcacccacaaatgggcgggcattctggcagtggtattcgcggcagctcattggctgattgaaatgggtgacgatgttatagagtcgattttcggaaaggccggcaggctgcacgatcaggattattccgggttcatcgacaccatgcgcgatgctgcggaagaggtaggggagttcgccgtctatctgctgttcgccatgctgttgatcactttgtggcgcaagtttccctacaaatactggcgttatttgcatcgcggcatgccggtgctttatctgttgctcgctttccacgcggcgtggctgactccgctgcaatggtggcagcagccaatcggactactgatggccattttgctctttggcgggagcatcgccagcgggctatctctgaccggcagagttggtcgtcgtcgccaggttcgcggcatggtcaccgcgatcaaaacaccagaccgggacgtcaccgaagttacctgccacatggggccggcatggcccggtcaccgtgcggggcaattcgcctttgtgaccttcgaccggattgagggtgcgcacccgttcaccatcgccagtgcggatcgggaaaatggcactgttaccttcctcatcaaatccctcggagactttacccgcaatctgagccagaaaatcagcgtggggcaaactgtaaatatagaaggcccttacggctgttttaacttcgatcgccgcaaccgcaaatcccaccagatctggatagccggtggcatcgggatcacgccgtttctggcctggctcgaagctctaagcagcgccaccgacgccaccgtgcctgaagccgatctgcattactgcacgcgcaacgccggccaggatcccatggtggatcgacttcgggcgctttgcgatggctttcccggaatacacctcgagattcatgacagcagcaaggggcagaggttgtctgccgagacgttgtctaccaacggacgctcggcagcaggcgcagaggtctggttctgcggcccggcagggctgggggaagccattagaaacggcttgcgggcagcacccttccgcctgactcgcttccataaagaagcttttcagttccgctga

SEQ ID NO: 357 - DNA, 1341 bp, Bordetella pertussis
atgcgacgcctgagaacaatattcattctgctggtcgcggccctgtccgtcctgtggctgagccagaacccgcccggcgcatggggcgagggcttctgggtcatgcgcaagcccctgatctactacaccggcatcctggccctgggcatgatgtcgctgggcgtgatcctggcggcgcggccggcccgcttcgaaggcgccctgggagggctggacaagttctaccggctgcacaagtggctgggcctgggcggcgtggcgctggcgctgacgcactggctgctgaagatcgtgccgccctggatggccgcgcagggctggaccgtgcggccgccgcgcgtgcccgcgccggccgggcaggcggccctgtacgacccgttccaggcctggcacggggtggccaagagcctgggcgagtgggggctgtacgccttgctgctgctggccgcgctggccctgtacaagcgctttccgtaccggcacttcttccgcacgcaccggctgatgcccgcgctgtacctggtgttcgtgtttcatgccgtggtgctgatggcgccggcctactggcgcgggcccatcgggccggtgatggccgtggtcatggccgccggcggcgcgggcgcgctgttgtcgctgctgggcctgatcggccgcccgcgccaggccgccggccgcattgcgcggctggagcgattcgccgacaacgcggtgatgcaggtcgacgtgcagctggagacgcgctggcccggccacaaggcgggccagttcgcgttcgtggccttcgaccgcgccgagggcgcgcatccgttcaccatttcgtcggcctggcgcgacgacggcttgctgcgcttcagcatcaaggggctgggcgactacacccgcagcctgccggcgcgcttgcgggtgggcgacggcgtgacggtggagggaccctatgggcgcttcgatttccgcgcgaacggcaggccgcagatcctggtggcgggcggcatcggtatcacgccgttcctggcgcggctccaggacatggccgccgctcgctccgatggcgcgccggcgcacgaggtggacctggtgtattccaccaatgcgccggacccggatttcatcggcgaactgcgcgccctggccgagcgcgcccgggtcggcctgcacgtgctggtgacgcagcgcgacggcaagctgagcgcggagcgcctggtcgacatgctgccgcgggccgcgcaatcggaagtgtggttctgcgggccggccgggttcggccaggccctgcgcgaaggcctggccgcccgcggcatgccgccggcctgctttcaccaggagctgttcgagatgcgctga

SEQ ID NO: 358 - DNA, 1271 bp, Artificial Sequence
  Optimized sequence
ggatcccatcatcaccatcaccatcatcatgcaggtctggtcccgcgtggcagtagatctatggaattttctatgaaatcggttaaaggtctgctgtttattatcgcgagctttattctgaccctgctgacgtggatgaacacctctccgcagtttatgattccgggcctggcactgaccagcctgtctctgacgtttatcctggctacccgtctgccgctgctggaatcatggttccattcgctggaaaaagtgtatacggttcacaaatttaccgctttcctgagtattatcctgctgatttttcataacttcagtatgggtggtctgtggggctcccgcctggcagcccagtttggtaatctggcgatttatatcttcgcctctattatcctggtggcatacctgggtaaatatattcaatacgaagcgtggcgttggattcatcgcctggtttatctggcgtacattctgggcctgtttcacatttatatgatcatgggtaaccgtctgctgacctttaatctgctgagcttcctggtgggctcttacgcactgctgggcctgctggctggtttctacatcatcttcctgtaccagaaaattagctttccgtatctgggtaaaatcacgcatctgaaacgtctgaaccacgatacccgcgaaattcagatccatctgtcacgcccgttcaattaccagtcgggccaatttgcgttcctgaaaatttttcaggaaggtttcgaatccgccccgcatccgtttagtatctccggcggtcacggccaaacgctgtatttcaccgttaaaacgagtggtgatcataccaaaaacatttacgacaatctgcaggcgggctccaaagtcacgctggatcgtgcctatggccacatgattatcgaagaaggtcgcgaaaaccaagtttggattgcaggcggtattggcatcaccccgtttatttcatatatccgtgaacatccgatcctggacaaacaggttcacttttattactcgttccgtggtgatgaaaacgcggtctatctggacctgctgcgcaattacgcccagaaaaacccgaattttgaactgcatctgattgatagcacgaaagacggctatctgaatttcgaacaaaaagaagtcccggaacacgccaccgtgtacatgtgcggtccgatctctatgatgaaagcactggctaaacaaatcaaaaaacaaaacccgaaaacggaactgatctacgaaggcttcaaattcaaatgagcggccgc

SEQ ID NO: 359 - DNA, 1373 bp, Artificial Sequence
  Optimized sequence
ggatcccaccatcaccatcaccatcatcatgctggcctggttccgcgtggcagcagatctatgaaactgctgtggggcgtcctggctgctgcgctggcagcatggggtctgaccctggcagttgatccgccggctagcctggacatttgggtggttcgtaaacaggcgatcctgctgacgggtgttgcgagctttgctctgatgtctctgattatgctgctggcagttcgtccggtctggctggaaaaaccgctggatggcctggaccgtatgtatcgcctgcataaatgggcaggcattctggctatcgtgctgggtctgctgcactacctgctggaactggcaggtccgtggctggcaggcattgtcggtaaaccggtgaaaggtccgcgtgttgaaacctttctggatgtcttccgcggctcagcgaaagaactgggtgaatggtcggcctggattctgggcggcatgctgctggtgacgctgtggcagcgttttccgtatcatctgtggcgctacgttcacaaagcactggctctggtgtatctggttctggcgttccatagtgtcgtgctggcaccggcaagttactggtcccagccggcaggttggctggttgcggcttgcgctctgctgggttctgcatgtgctctgctgagcctgtctggccgtatcggtcgcacccgtcgccatgcaggcgttgtcacggctgtcgaacgtcacggtgaatcactgctggaagtgacctgccgtctgcagggcgattggtcgcatcgcgcgggtcaatttgccttcctgacctgtgaccgcctggaaggtgcgcacccgtttacgattgcgagtgccgatcgtggctgcggtgaagtccgcttctccatcaaagcactgggcgattatacccgtcgcctgcaggacaacctggaagttggtgcgcgtgtggaagttgaaggcccgtacggttgttttgatttccgtcgcggcctggcaggtcgtcaagtctgggtggcagcaggtattggtgtgacgccgtttatcgcgtggctggaaagcctgcaggcagctccggaatcagccccgtcggtggaactgcactattgcgttcgtaattctcaagaagcgctgttcgcaggtcgtctgcgtgaactgtgtgaacatctgccgagcgttaccctgcacattcgttactctgacgaacagggtaaaccgcaggcggcccaactgggcgttctgaaaagtgccgaaggtcgttggccgtccgtctggttttgcggtccgcaaggtctggcagattccctgcgtcgcgatctgcgtcgccagggtatgccgctgcgtctgttccaccaagaagcgtttcgtatgcgttgagcggccgc

SEQ ID NO: 360 - DNA, 1394 bp, Artificial Sequence
  Optimized sequence
ggatcccatcatcatcatcatcatcatcacgcaggtctggttccgcgcggctcaagatctatgaaaaaagcaaatctgacgggcacgctggtttgctttgtggcttgtctgatttttctgagcagcggcgatatctttcgtgaaaaaccgattgcactgatctggttcctgcgccagaacattctgtttttcaccggtacgctggcgtggtgcctgatgaccctgacgatgtgtctgagcctgcgtagttcctggctgaataaagttctgggcggtctggataaagcgtggcgcctgcacaaatgggcgggcatttgcgcgatcgcctttgcattcgctcattggctggatgaaaaactgccgcagctgtttgtcgcattcggttggctgacccacccgggtaaaattgtggacatcaacctgacgccggttcaagaaaattggctgcatgcaggcctgctggctggtgaatgcgcgatgtttattatcattgcgatggtgtgtgttagtctgtccaaacgtgtcccgtatcacctgtttcacctggttcatcgcctgtttccggtcttctacctggcgattgcctttcacgtgttcacggccctgtttaaatcttattggtgggaaaccccggcggcctacctgctgatcctgattacgatcccgggcgtgtttgcagctttcatctcactgctgaaactgaacggttcgaaaaataaacaccaggccaccattaaaaacatcgtcaatcatccgggccaaattaccgaagtgacgctggaactggaacatgcaatcgattatagtccgggccagtttgccttcctgacctttgcacacagcaaagaatctcatccgttcaccattgcctcctatacgaaagagaaaaacaccctgcgttttgcaatcaaaaatctgggcgattacaccagcacgctggcgtcatcgattaaaatcggtcaatctgccttcgtggaaggcccgtggggtaaatttgacttcaccctgccgtgcagtcatcaggtttggattgcaggcggtattggcatcaccccgtttatcgctcaactggaatatcgtaaacatcacggtgcgagcagcgtgccggtggatatttggtattgcgtttcacgctcggaagatgcctggtatgtggacaaactgacgagcctgtgtgcacaggctcgtgttaccctgcacctgctggacgcccataaaggtgaacgcctgcaagcacactacctgacggataaaattgctaacaaaggcgacacccatttttggttctgtggtccgcagagttttgcgaaagccctgtccaaaggcctgtatgaaaatggtattgcgtcccagaacttccactacgaccgtttttgtatgcgttgagcggccgc

SEQ ID NO: 361 - DNA, 1200 bp, Artificial Sequence
  Optimized sequence
ggcgctgatgctgatgtctctggcgatgctgctggcgctgcgtctgccgctgatcgaacagtggacccagggtatcgacaaaggttaccgtatccacaaatggctgggtatctctgcgctgctgctgggtatcttccactggctggcgtaccacctgccgaaatggctgatctctctggaactgctgaccaaaccggcgcgtctgaacggttctggtccgaactctaacctgtctggtctggcgctgtggctgaaagaagcgaaaccgctggcgatggaaatcggtgaatggggtttctacgcgctgatcgttctgctggttgtttctctgtggtctgcgatcaaatacaaaccgttccgtctgacccaccgtctgatggcggttgtttacctgctgatcgcgctgcactctgttatcctgctgaaaaaagcgtactggggtgaaccgatctactggctgaccatgctgttcatcgttgttggttcttgggcggcgtgctactctctgctgggtctggttggtcgtcagtctcgttacccggcgcacgttaaagcgttccactactgcccgaactctcagaccctggacctgaccatccagctggacaaaccgtggctgggtcacaaagcgggtcagttcgcgtacctgaaattcgcgggtgaagaaccgcacccgttcaccatcgcgtgcgcgcaccagggttctcagctgcgtttcctgatcaaagaactgggtgacttcaccaccggtctgcaccagcgtctgcagaacggtaaatctctggaagttgaaggtccgtacggtaaattcgacttctctacccagcagccgcaaatttggatcggtggtggtgttggtatcgcgccgttcatggcgggtctggactggctgatgcgtgaacgtgcgcacccgccggttcacctgttcttctgctgccaccagatcgacccggacctgtgcgcggaactgcgtcacaaagcgcagctggcgggtgtttctctgaccatcatcgactcttctgttgacccgcacctgtctgcggacgacatcgcgcgtcgttgcggtgacctgtctcgtttcgaaatctacttctgcggtccgatcgcgttctctaactctctgaaaaaagcgctgaaaccgtaccaggttgacctgtctcgtcagttccacgaagaacagttcgttatgcgttgagcggc

SEQ ID NO: 362 - DNA, 1385 bp, Artificial Sequence
  Optimized sequence
ggatcccatcatcaccatcaccatcaccatgccggtctggtcccgcgtggcagcagatctatgatgcgtatgatcttcccgttcgttgttctggttctgggtctgtgggcgtggaacctgttcgcgggtccgggtgcgggttctccgtgggcggtttacgaccagtctctgctgctgtctggtctgctgtctatcgcgctgatgtctctgaccatgatgctggcgctgcgtccggcgtggctggaacgtccgctgggtggtctggaccaaatttatcgtacccacaaatgggcgggtatcctggcggttgttttcgcggcggcgcactggctgatcgaaatgggtgacgacgttatcgaatctatcttcggtaaagcgggtcgtctgcacgaccaggactactctggtttcatcgacaccatgcgtgacgcggcggaagaagttggtgaattcgcggtttacctgctgttcgcgatgctgctgatcaccctgtggcgtaaattcccgtacaaatactggcgttacctgcaccgtggtatgccggttctgtacctgctgctggcgttccacgcggcgtggctgaccccgctgcagtggtggcagcagccgatcggtctgctgatggcgatcctgctgttcggtggttctatcgcgtctggtctgtctctgaccggtcgtgttggtcgtcgtcgtcaggttcgtggtatggttaccgcgatcaaaaccccggaccgtgacgttaccgaagttacctgccacatgggtccggcgtggccgggtcaccgtgcgggtcagttcgcgttcgttaccttcgaccgtatcgaaggtgcgcacccgttcaccatcgcgtctgcggaccgtgaaaacggtaccgttaccttcctgatcaaatctctgggtgacttcacccgtaacctgtctcagaaaatctctgttggtcagaccgttaacatcgaaggtccgtacggttgcttcaacttcgaccgtcgtaaccgtaaatctcaccaaatttggatcgcgggtggtatcggtatcaccccgttcctggcgtggctggaagcgctgtcttctgcgaccgacgcgaccgttccggaagcggacctgcactactgcacccgtaacgcgggtcaggacccgatggttgaccgtctgcgtgcgctgtgcgacggtttcccgggtatccacctggaaatccacgactcttctaaaggtcagcgtctgtctgcggaaaccctgtctaccaacggtcgttctgcggcgggtgcggaagtttggttctgcggtccggcgggtctgggtgaagcgatccgtaacggtctgcgtgcggcgccgttccgtctgacccgtttccacaaagaagcgttccagttccgttgagcggccgc

SEQ ID NO: 363 - DNA, 1409 bp, Artificial Sequence
  Optimized sequence
ggatcccatcatcaccatcaccatcaccatgccggtctggtcccgcgtggcagcagatctatgcgtcgtctgcgtaccatcttcatcctgctggttgcggcgctgtctgttctgtggctgtctcagaacccgccgggtgcgtggggtgaaggtttctgggttatgcgtaaaccgctgatctactacaccggtatcctggcgctgggtatgatgtctctgggtgttatcctggcggcgcgtccggcgcgtttcgaaggtgcgctgggtggtctggacaaattctaccgtctgcacaaatggctgggtctgggtggtgttgcgctggcgctgacccactggctgctgaaaatcgttccgccgtggatggcggcgcagggttggaccgttcgtccgccgcgtgttccggcgccggcgggtcaggcggcgctgtacgacccgttccaggcgtggcacggtgttgcgaaatctctgggtgaatggggtctgtacgcgctgctgctgctggcggcgctggcgctgtacaaacgtttcccgtaccgtcacttcttccgtacccaccgtctgatgccggcgctgtacctggttttcgttttccacgcggttgttctgatggcgccggcgtactggcgtggtccgatcggtccggttatggcggttgttatggcggcgggtggtgcgggtgcgctgctgtctctgctgggtctgatcggtcgtccgcgtcaggcggcgggtcgtatcgcgcgtctggaacgtttcgcggacaacgcggttatgcaggttgacgttcagctggaaacccgttggccgggtcacaaagcgggtcagttcgcgttcgttgcgttcgaccgtgcggaaggtgcgcacccgttcaccatctcttctgcgtggcgtgacgacggtctgctgcgtttctctatcaaaggtctgggtgactacacccgttctctgccggcgcgtctgcgtgttggtgacggtgttaccgttgaaggtccgtacggtcgtttcgacttccgtgcgaacggtcgtccgcagatcctggttgcgggtggtatcggtatcaccccgttcctggcgcgtctgcaggacatggcggcggcgcgttctgacggtgcgccggcgcacgaagttgacctggtttactctaccaacgcgccggacccggacttcatcggtgaactgcgtgcgctggcggaacgtgcgcgtgttggtctgcacgttctggttacccagcgtgacggtaaactgtctgcggaacgtctggttgacatgctgccgcgtgcggcgcagtctgaagtttggttctgcggtccggcgggtttcggtcaggcgctgcgtgaaggtctggcggcgcgtggtatgccgccggcgtgcttccaccaggaactgttcgaaatgcgttgagcggccgc

SEQ ID NO: 364 - DNA, 6059 bp, Artificial Sequence
  Plasmid
ctcgagcttaattaacaacaccatttgtcgagaaatcataaaaaatttatttgctttgtgagcggataacaattataatagattcaattgtgagcggataacaatttcacacagaattcattaaagaggagaaattaactatgggatcccatcatcaccatcaccatcatcatgcaggtctggtcccgcgtggcagtagatctatggaattttctatgaaatcggttaaaggtctgctgtttattatcgcgagctttattctgaccctgctgacgtggatgaacacctctccgcagtttatgattccgggcctggcactgaccagcctgtctctgacgtttatcctggctacccgtctgccgctgctggaatcatggttccattcgctggaaaaagtgtatacggttcacaaatttaccgctttcctgagtattatcctgctgatttttcataacttcagtatgggtggtctgtggggctcccgcctggcagcccagtttggtaatctggcgatttatatcttcgcctctattatcctggtggcatacctgggtaaatatattcaatacgaagcgtggcgttggattcatcgcctggtttatctggcgtacattctgggcctgtttcacatttatatgatcatgggtaaccgtctgctgacctttaatctgctgagcttcctggtgggctcttacgcactgctgggcctgctggctggtttctacatcatcttcctgtaccagaaaattagctttccgtatctgggtaaaatcacgcatctgaaacgtctgaaccacgatacccgcgaaattcagatccatctgtcacgcccgttcaattaccagtcgggccaatttgcgttcctgaaaatttttcaggaaggtttcgaatccgccccgcatccgtttagtatctccggcggtcacggccaaacgctgtatttcaccgttaaaacgagtggtgatcataccaaaaacatttacgacaatctgcaggcgggctccaaagtcacgctggatcgtgcctatggccacatgattatcgaagaaggtcgcgaaaaccaagtttggattgcaggcggtattggcatcaccccgtttatttcatatatccgtgaacatccgatcctggacaaacaggttcacttttattactcgttccgtggtgatgaaaacgcggtctatctggacctgctgcgcaattacgcccagaaaaacccgaattttgaactgcatctgattgatagcacgaaagacggctatctgaatttcgaacaaaaagaagtcccggaacacgccaccgtgtacatgtgcggtccgatctctatgatgaaagcactggctaaacaaatcaaaaaacaaaacccgaaaacggaactgatctacgaaggcttcaaattcaaatgagcggccgcctaggacccagctttcttgtacaaagtggtaagcttaattagctgagcttggactcctgttgatagatccagtaatgacctcagaactccatctggatttgttcagaacgctcggttgccgccgggcgttttttattggtgagaatccaagtaacaacaccatttaaatggagtggttacaaatggagtggttaattaaggctagcttggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttaaacgcctggggtaatgactctctagcttgaggcatcaaataaaacgaaaggctcagtcgaaagactgggcctttcgttttatctgttgtttgtcggtgaacgctctcctgagtaggacaaatccgccctctagattacgtgcagtcgatgataagctgtcaaacatgagaattgtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatatccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcaccattcgatggtgtcggaatttcgggcagcgttgggtcctggccacgggtgcgcatgatctagagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccacatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcac

SEQ ID NO: 365 - DNA, 6161 bp, Artificial Sequence
  Plasmid
ctcgagcttaattaacaacaccatttgtcgagaaatcataaaaaatttatttgctttgtgagcggataacaattataatagattcaattgtgagcggataacaatttcacacagaattcattaaagaggagaaattaactatgggatcccaccatcaccatcaccatcatcatgctggcctggttccgcgtggcagcagatctatgaaactgctgtggggcgtcctggctgctgcgctggcagcatggggtctgaccctggcagttgatccgccggctagcctggacatttgggtggttcgtaaacaggcgatcctgctgacgggtgttgcgagctttgctctgatgtctctgattatgctgctggcagttcgtccggtctggctggaaaaaccgctggatggcctggaccgtatgtatcgcctgcataaatgggcaggcattctggctatcgtgctgggtctgctgcactacctgctggaactggcaggtccgtggctggcaggcattgtcggtaaaccggtgaaaggtccgcgtgttgaaacctttctggatgtcttccgcggctcagcgaaagaactgggtgaatggtcggcctggattctgggcggcatgctgctggtgacgctgtggcagcgttttccgtatcatctgtggcgctacgttcacaaagcactggctctggtgtatctggttctggcgttccatagtgtcgtgctggcaccggcaagttactggtcccagccggcaggttggctggttgcggcttgcgctctgctgggttctgcatgtgctctgctgagcctgtctggccgtatcggtcgcacccgtcgccatgcaggcgttgtcacggctgtcgaacgtcacggtgaatcactgctggaagtgacctgccgtctgcagggcgattggtcgcatcgcgcgggtcaatttgccttcctgacctgtgaccgcctggaaggtgcgcacccgtttacgattgcgagtgccgatcgtggctgcggtgaagtccgcttctccatcaaagcactgggcgattatacccgtcgcctgcaggacaacctggaagttggtgcgcgtgtggaagttgaaggcccgtacggttgttttgatttccgtcgcggcctggcaggtcgtcaagtctgggtggcagcaggtattggtgtgacgccgtttatcgcgtggctggaaagcctgcaggcagctccggaatcagccccgtcggtggaactgcactattgcgttcgtaattctcaagaagcgctgttcgcaggtcgtctgcgtgaactgtgtgaacatctgccgagcgttaccctgcacattcgttactctgacgaacagggtaaaccgcaggcggcccaactgggcgttctgaaaagtgccgaaggtcgttggccgtccgtctggttttgcggtccgcaaggtctggcagattccctgcgtcgcgatctgcgtcgccagggtatgccgctgcgtctgttccaccaagaagcgtttcgtatgcgttgagcggccgcctaggacccagctttcttgtacaaagtggtaagcttaattagctgagcttggactcctgttgatagatccagtaatgacctcagaactccatctggatttgttcagaacgctcggttgccgccgggcgttttttattggtgagaatccaagtaacaacaccatttaaatggagtggttacaaatggagtggttaattaaggctagcttggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttaaacgcctggggtaatgactctctagcttgaggcatcaaataaaacgaaaggctcagtcgaaagactgggcctttcgttttatctgttgtttgtcggtgaacgctctcctgagtaggacaaatccgccctctagattacgtgcagtcgatgataagctgtcaaacatgagaattgtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatatccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcaccattcgatggtgtcggaatttcgggcagcgttgggtcctggccacgggtgcgcatgatctagagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccacatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcac

SEQ ID NO: 366 - DNA, 6182 bp, Artificial Sequence
  Plasmid
ctcgagcttaattaacaacaccatttgtcgagaaatcataaaaaatttatttgctttgtgagcggataacaattataatagattcaattgtgagcggataacaatttcacacagaattcattaaagaggagaaattaactatgggatcccatcatcatcatcatcatcatcacgcaggtctggttccgcgcggctcaagatctatgaaaaaagcaaatctgacgggcacgctggtttgctttgtggcttgtctgatttttctgagcagcggcgatatctttcgtgaaaaaccgattgcactgatctggttcctgcgccagaacattctgtttttcaccggtacgctggcgtggtgcctgatgaccctgacgatgtgtctgagcctgcgtagttcctggctgaataaagttctgggcggtctggataaagcgtggcgcctgcacaaatgggcgggcatttgcgcgatcgcctttgcattcgctcattggctggatgaaaaactgccgcagctgtttgtcgcattcggttggctgacccacccgggtaaaattgtggacatcaacctgacgccggttcaagaaaattggctgcatgcaggcctgctggctggtgaatgcgcgatgtttattatcattgcgatggtgtgtgttagtctgtccaaacgtgtcccgtatcacctgtttcacctggttcatcgcctgtttccggtcttctacctggcgattgcctttcacgtgttcacggccctgtttaaatcttattggtgggaaaccccggcggcctacctgctgatcctgattacgatcccgggcgtgtttgcagctttcatctcactgctgaaactgaacggttcgaaaaataaacaccaggccaccattaaaaacatcgtcaatcatccgggccaaattaccgaagtgacgctggaactggaacatgcaatcgattatagtccgggccagtttgccttcctgacctttgcacacagcaaagaatctcatccgttcaccattgcctcctatacgaaagagaaaaacaccctgcgttttgcaatcaaaaatctgggcgattacaccagcacgctggcgtcatcgattaaaatcggtcaatctgccttcgtggaaggcccgtggggtaaatttgacttcaccctgccgtgcagtcatcaggtttggattgcaggcggtattggcatcaccccgtttatcgctcaactggaatatcgtaaacatcacggtgcgagcagcgtgccggtggatatttggtattgcgtttcacgctcggaagatgcctggtatgtggacaaactgacgagcctgtgtgcacaggctcgtgttaccctgcacctgctggacgcccataaaggtgaacgcctgcaagcacactacctgacggataaaattgctaacaaaggcgacacccatttttggttctgtggtccgcagagttttgcgaaagccctgtccaaaggcctgtatgaaaatggtattgcgtcccagaacttccactacgaccgtttttgtatgcgttgagcggccgcctaggacccagctttcttgtacaaagtggtaagcttaattagctgagcttggactcctgttgatagatccagtaatgacctcagaactccatctggatttgttcagaacgctcggttgccgccgggcgttttttattggtgagaatccaagtaacaacaccatttaaatggagtggttacaaatggagtggttaattaaggctagcttggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttaaacgcctggggtaatgactctctagcttgaggcatcaaataaaacgaaaggctcagtcgaaagactgggcctttcgttttatctgttgtttgtcggtgaacgctctcctgagtaggacaaatccgccctctagattacgtgcagtcgatgataagctgtcaaacatgagaattgtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatatccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcaccattcgatggtgtcggaatttcgggcagcgttgggtcctggccacgggtgcgcatgatctagagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccacatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcac

SEQ ID NO: 367 - DNA, 6071 bp, Artificial Sequence
  Plasmid
ctcgagcttaattaacaacaccatttgtcgagaaatcataaaaaatttatttgctttgtgagcggataacaattataatagattcaattgtgagcggataacaatttcacacagaattcattaaagaggagaaattaactatgggatcccatcatcaccatcaccatcaccatgccggtctggtcccgcgtggcagcagatctatgcagttctctggtatcctggcgctgatgctgatgtctctggcgatgctgctggcgctgcgtctgccgctgatcgaacagtggacccagggtatcgacaaaggttaccgtatccacaaatggctgggtatctctgcgctgctgctgggtatcttccactggctggcgtaccacctgccgaaatggctgatctctctggaactgctgaccaaaccggcgcgtctgaacggttctggtccgaactctaacctgtctggtctggcgctgtggctgaaagaagcgaaaccgctggcgatggaaatcggtgaatggggtttctacgcgctgatcgttctgctggttgtttctctgtggtctgcgatcaaatacaaaccgttccgtctgacccaccgtctgatggcggttgtttacctgctgatcgcgctgcactctgttatcctgctgaaaaaagcgtactggggtgaaccgatctactggctgaccatgctgttcatcgttgttggttcttgggcggcgtgctactctctgctgggtctggttggtcgtcagtctcgttacccggcgcacgttaaagcgttccactactgcccgaactctcagaccctggacctgaccatccagctggacaaaccgtggctgggtcacaaagcgggtcagttcgcgtacctgaaattcgcgggtgaagaaccgcacccgttcaccatcgcgtgcgcgcaccagggttctcagctgcgtttcctgatcaaagaactgggtgacttcaccaccggtctgcaccagcgtctgcagaacggtaaatctctggaagttgaaggtccgtacggtaaattcgacttctctacccagcagccgcaaatttggatcggtggtggtgttggtatcgcgccgttcatggcgggtctggactggctgatgcgtgaacgtgcgcacccgccggttcacctgttcttctgctgccaccagatcgacccggacctgtgcgcggaactgcgtcacaaagcgcagctggcgggtgtttctctgaccatcatcgactcttctgttgacccgcacctgtctgcggacgacatcgcgcgtcgttgcggtgacctgtctcgtttcgaaatctacttctgcggtccgatcgcgttctctaactctctgaaaaaagcgctgaaaccgtaccaggttgacctgtctcgtcagttccacgaagaacagttcgttatgcgttgagcggccgcctaggacccagctttcttgtacaaagtggtaagcttaattagctgagcttggactcctgttgatagatccagtaatgacctcagaactccatctggatttgttcagaacgctcggttgccgccgggcgttttttattggtgagaatccaagtaacaacaccatttaaatggagtggttacaaatggagtggttaattaaggctagcttggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttaaacgcctggggtaatgactctctagcttgaggcatcaaataaaacgaaaggctcagtcgaaagactgggcctttcgttttatctgttgtttgtcggtgaacgctctcctgagtaggacaaatccgccctctagattacgtgcagtcgatgataagctgtcaaacatgagaattgtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatatccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcaccattcgatggtgtcggaatttcgggcagcgttgggtcctggccacgggtgcgcatgatctagagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccacatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcac

SEQ ID NO: 368 - DNA, 6173 bp, Artificial Sequence
  Plasmid
ctcgagcttaattaacaacaccatttgtcgagaaatcataaaaaatttatttgctttgtgagcggataacaattataatagattcaattgtgagcggataacaatttcacacagaattcattaaagaggagaaattaactatgggatcccatcatcaccatcaccatcaccatgccggtctggtcccgcgtggcagcagatctatgatgcgtatgatcttcccgttcgttgttctggttctgggtctgtgggcgtggaacctgttcgcgggtccgggtgcgggttctccgtgggcggtttacgaccagtctctgctgctgtctggtctgctgtctatcgcgctgatgtctctgaccatgatgctggcgctgcgtccggcgtggctggaacgtccgctgggtggtctggaccaaatttatcgtacccacaaatgggcgggtatcctggcggttgttttcgcggcggcgcactggctgatcgaaatgggtgacgacgttatcgaatctatcttcggtaaagcgggtcgtctgcacgaccaggactactctggtttcatcgacaccatgcgtgacgcggcggaagaagttggtgaattcgcggtttacctgctgttcgcgatgctgctgatcaccctgtggcgtaaattcccgtacaaatactggcgttacctgcaccgtggtatgccggttctgtacctgctgctggcgttccacgcggcgtggctgaccccgctgcagtggtggcagcagccgatcggtctgctgatggcgatcctgctgttcggtggttctatcgcgtctggtctgtctctgaccggtcgtgttggtcgtcgtcgtcaggttcgtggtatggttaccgcgatcaaaaccccggaccgtgacgttaccgaagttacctgccacatgggtccggcgtggccgggtcaccgtgcgggtcagttcgcgttcgttaccttcgaccgtatcgaaggtgcgcacccgttcaccatcgcgtctgcggaccgtgaaaacggtaccgttaccttcctgatcaaatctctgggtgacttcacccgtaacctgtctcagaaaatctctgttggtcagaccgttaacatcgaaggtccgtacggttgcttcaacttcgaccgtcgtaaccgtaaatctcaccaaatttggatcgcgggtggtatcggtatcaccccgttcctggcgtggctggaagcgctgtcttctgcgaccgacgcgaccgttccggaagcggacctgcactactgcacccgtaacgcgggtcaggacccgatggttgaccgtctgcgtgcgctgtgcgacggtttcccgggtatccacctggaaatccacgactcttctaaaggtcagcgtctgtctgcggaaaccctgtctaccaacggtcgttctgcggcgggtgcggaagtttggttctgcggtccggcgggtctgggtgaagcgatccgtaacggtctgcgtgcggcgccgttccgtctgacccgtttccacaaagaagcgttccagttccgttgagcggccgcctaggacccagctttcttgtacaaagtggtaagcttaattagctgagcttggactcctgttgatagatccagtaatgacctcagaactccatctggatttgttcagaacgctcggttgccgccgggcgttttttattggtgagaatccaagtaacaacaccatttaaatggagtggttacaaatggagtggttaattaaggctagcttggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttaaacgcctggggtaatgactctctagcttgaggcatcaaataaaacgaaaggctcagtcgaaagactgggcctttcgttttatctgttgtttgtcggtgaacgctctcctgagtaggacaaatccgccctctagattacgtgcagtcgatgataagctgtcaaacatgagaattgtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatatccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcaccattcgatggtgtcggaatttcgggcagcgttgggtcctggccacgggtgcgcatgatctagagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccacatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcac

SEQ ID NO: 369 - DNA, 6197 bp, Artificial Sequence
  Plasmid
ctcgagcttaattaacaacaccatttgtcgagaaatcataaaaaatttatttgctttgtgagcggataacaattataatagattcaattgtgagcggataacaatttcacacagaattcattaaagaggagaaattaactatgggatcccatcatcaccatcaccatcaccatgccggtctggtcccgcgtggcagcagatctatgcgtcgtctgcgtaccatcttcatcctgctggttgcggcgctgtctgttctgtggctgtctcagaacccgccgggtgcgtggggtgaaggtttctgggttatgcgtaaaccgctgatctactacaccggtatcctggcgctgggtatgatgtctctgggtgttatcctggcggcgcgtccggcgcgtttcgaaggtgcgctgggtggtctggacaaattctaccgtctgcacaaatggctgggtctgggtggtgttgcgctggcgctgacccactggctgctgaaaatcgttccgccgtggatggcggcgcagggttggaccgttcgtccgccgcgtgttccggcgccggcgggtcaggcggcgctgtacgacccgttccaggcgtggcacggtgttgcgaaatctctgggtgaatggggtctgtacgcgctgctgctgctggcggcgctggcgctgtacaaacgtttcccgtaccgtcacttcttccgtacccaccgtctgatgccggcgctgtacctggttttcgttttccacgcggttgttctgatggcgccggcgtactggcgtggtccgatcggtccggttatggcggttgttatggcggcgggtggtgcgggtgcgctgctgtctctgctgggtctgatcggtcgtccgcgtcaggcggcgggtcgtatcgcgcgtctggaacgtttcgcggacaacgcggttatgcaggttgacgttcagctggaaacccgttggccgggtcacaaagcgggtcagttcgcgttcgttgcgttcgaccgtgcggaaggtgcgcacccgttcaccatctcttctgcgtggcgtgacgacggtctgctgcgtttctctatcaaaggtctgggtgactacacccgttctctgccggcgcgtctgcgtgttggtgacggtgttaccgttgaaggtccgtacggtcgtttcgacttccgtgcgaacggtcgtccgcagatcctggttgcgggtggtatcggtatcaccccgttcctggcgcgtctgcaggacatggcggcggcgcgttctgacggtgcgccggcgcacgaagttgacctggtttactctaccaacgcgccggacccggacttcatcggtgaactgcgtgcgctggcggaacgtgcgcgtgttggtctgcacgttctggttacccagcgtgacggtaaactgtctgcggaacgtctggttgacatgctgccgcgtgcggcgcagtctgaagtttggttctgcggtccggcgggtttcggtcaggcgctgcgtgaaggtctggcggcgcgtggtatgccgccggcgtgcttccaccaggaactgttcgaaatgcgttgagcggccgcctaggacccagctttcttgtacaaagtggtaagcttaattagctgagcttggactcctgttgatagatccagtaatgacctcagaactccatctggatttgttcagaacgctcggttgccgccgggcgttttttattggtgagaatccaagtaacaacaccatttaaatggagtggttacaaatggagtggttaattaaggctagcttggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttaaacgcctggggtaatgactctctagcttgaggcatcaaataaaacgaaaggctcagtcgaaagactgggcctttcgttttatctgttgtttgtcggtgaacgctctcctgagtaggacaaatccgccctctagattacgtgcagtcgatgataagctgtcaaacatgagaattgtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatatccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcaccattcgatggtgtcggaatttcgggcagcgttgggtcctggccacgggtgcgcatgatctagagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccacatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcac

SEQ ID NO: 370 - protein, 570 aa, Homo sapiens
MGNWAVNEGLSIFVILVWLGLNVFLFVWYYRVYDIPPKFFYTRKLLGSALALARAPAACLNFNCMLILLPVCRNLLSFLRGSSACCSTRVRRQLDRNLTFHKMVAWMIALHSAIHTIAHLFNVEWCVNARVNNSDPYSVALSELGDRQNESYLNFARKRIKNPEGGLYLAVTLLAGITGVVITLCLILIITSSTKTIRRSYFEVFWYTHHLFVIFFIGLAIHGAERIVRGQTAESLAVHNITVCEQKISEWGKIKECPIPQFAGNPPMTWKWIVGPMFLYLCERLVRFWRSQQKVVITKVVTHPFKTIELQMKKKGFKMEVGQYIFVKCPKVSKLEWHPFTLTSAPEEDFFSIHIRIVGDWTEGLFNACGCDKQEFQDAWKLPKIAVDGPFGTASEDVFSYEVVMLVGAGIGVTPFASILKSVWYKYCNNATNLKLKKIYFYWLCRDTHAFEWFADLLQLLESQMQERNNAGFLSYNIYLTGWDESQANHFAVHHDEEKDVITGLKQKTLYGRPNWDNEFKTIASQHPNTRIGVFLCGPEALAETLSKQSISNSESGPRGVHFIFNKENF

The invention claimed is:

1. A NADPH oxidase (Nox) protein comprising:
   (a) a domain comprising from 3 to 7 transmembrane helices;
   (b) an amino acid sequence comprising at least 2 bis-histidyl motifs, wherein each of the bis-histidyl motifs consists of 2 histidine residues separated by 12, 13 or 14 amino acid residues;
   (c) at least one first motif consisting of the sequence:

[G/S/A]-[Q/D]-F-[A/V/T/L/F]-[F/Y/W/L/R]-[L/V/I/F/W]; (SEQ ID NO: 1)

(d) at least one second motif consisting of the sequence:

[P/A/S/E/F]-H-[P/S/A]-F-[T/S]-[L/I/M/V]; (SEQ ID NO: 2)

(e) at least one third motif consisting of the sequence:

[K/R]-X-X-G-[D/G]-X-[T/S] (SEQ ID NO: 3), wherein X represents any naturally occurring amino acid; and
   (f) at least one fourth motif consisting of the sequence:

G-[I/S/V/L]-G-[V/I/A/F]-[T/A/S]-[P/Y/T/A], (SEQ ID NO: 4)

wherein the Nox protein is produced in a host cell comprising an expression vector comprising a nucleic acid sequence selected from the group consisting of the sequences SEQ ID NOs: 365 to 369.

2. The Nox protein of claim 1, wherein said first motif is selected from the group consisting of the sequences SEQ ID NO: 8, SEQ ID NO: 9 and SEQ ID NO: 10.

3. The Nox protein of claim 1, wherein said second motif is selected from the group consisting of the sequences, SEQ ID NO: 12, SEQ ID NO: 13 and SEQ ID NO: 14.

4. The Nox protein of claim 1, wherein said third motif is selected from the group consisting of the sequences, SEQ ID NO: 16, SEQ ID NO: 17, SEQ ID NO: 18, SEQ ID NO: 19, and SEQ ID NO: 20.

5. The Nox protein of claim 1, wherein said fourth motif is selected from the group consisting of the sequences SEQ ID NO: 21, SEQ ID NO: 22 and SEQ ID NO: 23.

6. The Nox protein of claim 1, wherein the Nox protein comprises NADPH oxidase activity which catalyzes the production of reactive oxygen species (ROS) in the presence of an electron donor.

7. The Nox protein of claim 6, wherein said NADPH oxidase activity is capable of being detected in a sample comprising said protein via a reaction showing production of superoxide ion.

8. The Nox protein of claim 1, wherein said host cell is a bacterium.

9. A method for producing the Nox protein of claim 1, the method comprising the steps of:
   (a) providing a solution of cells comprising said Nox protein in the cellular membranes of said cells; and
   (b) using at least one detergent from the maltoside family, solubilizing the cell membranes to place said Nox protein in suspension in said solution.

10. The method of claim 9, wherein said at least one detergent is a dodecyl-maltoside.

11. The method of claim 9, wherein said at least one detergent is selected from the group consisting of: n-Dodecyl-β-D-Maltopyranoside; n-Decyl-α-D-Maltopyranoside; 2,6-Dimethyl-4-Heptyl-β-D-Maltopyranoside; HEGA-11; n-Hexyl-β-D-Maltopyranoside; n-Hexadecyl-β-D-Maltopyranoside; n-Nonyl-β-D-Maltopyranoside; n-Octyl-β-D-Maltopyranoside; 2-Propyl-1-Pentyl-β-D-Maltopyranoside; n-Tetradecyl-β-D-Maltopyranoside; n-Tridecyl-β-D-Maltopyranoside; n-Undecyl-β-D-Maltopyranoside; n-Undecyl-α-D-Maltopyranoside; ω-Undecylenyl-β-D-Maltopyranoside; n-Decyl-β-D-Thiomaltopyranoside; n-Dodecyl-β-D-Thiomaltopyranoside; n-Octyl-β-D-Thiomaltopyranoside; n-Nonyl-β-D-Thiomaltopyranoside; n-Undecyl-β-D-Thiomaltopyranoside; Lauryl Maltose Neopentyl Glycol (MNG3); Decyl Maltose Neopentyl Glycol; CYMAL-5 Neopentyl Glycol; CYMAL-6 Neopentyl Glycol; CYMAL-7 Neopentyl Glycol; CYMAL-1; CYMAL-2; CYMAL-3; CYMAL-4; CYMAL-5; CYMAL-6; CYMAL-7; Octyl Maltoside, Fluorinated; BisMalt-18; BisMalt-20; BisMalt-22; BisMalt-24; BisMalt-28; n-Dodecyl-d25-β-D-Maltopyranoside; Decyl-β-D-Selenomaltoside; Dodecyl-β-D-Selenomaltoside; Octyl-β-D-Selenomaltoside; and Undecyl-β-D-Selenomaltoside.

* * * * *